United States Patent 11,479,782 (ALFALFA WITH REDUCED LIGNIN COMPOSITION) - sequence listing, part 2

SEQ ID NO: 6299 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacgtgttcagttcgtactcaacaagatggaaaggttcagagactttatggtttggctactgttgctaa

SEQ ID NO: 6300 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 6301 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactatatggtttggctactgttgctaa

SEQ ID NO: 6302 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 6303 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcggcgcttggcttgttacaatatcctcactttttcagttcgtactcaacaagatggaaaggttcagagcctttatggtttggctactgttgctaa

SEQ ID NO: 6304 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgtgtctcttggcttgttacaatatcctcacttgttctgttcgtactcaacaagatggaaaggttcagagactttatggtttggctactgttgctaa

SEQ ID NO: 6305 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttacggtttggctactgttgctaa

SEQ ID NO: 6306 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcactttttcagttcgtactcaacaagatggaaagattcagagcctttatggtttggctactgttgctaa

SEQ ID NO: 6307 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcggagactttatggtttggctactgttgctaa

SEQ ID NO: 6308 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcctgttacaatatcctcacttgttcagttcgtactcaacaagatggaaaggttcagagactttatggtttggctactgttgctaa

SEQ ID NO: 6309 - DNA, 360 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgtgctaa

SEQ ID NO: 6310 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctctcggcttgttacaatatcctcacttgttcagttcgtactcaacaagatggaaaagttcagagactttatggtttggctactgttgctaa

SEQ ID NO: 6311 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttgcaatatcctcacttgttcagttcgtactcaacaagatggaaaggttcagagactttatggtttggctactgttgctaa

SEQ ID NO: 6312 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttgggccgaatgttgcgtctcttggcttgttacaatatcctcacttgttcagttcgtactcaacaagatggaaaggttcagagactttatggtttggctactgttgctaa

SEQ ID NO: 6313 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgggacaagagccgcacgggggcagggcgtactcaacaagatggaaagattcagagactttatggtttggctactgttgctaa

SEQ ID NO: 6314 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatgggaaggttcagagactttatggtttggctactgttgctaa

SEQ ID NO: 6315 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttagaatatcctcacttgttcagttcgtactcaacaagatggaaaggttcagagactttatggtttggctactgttgctaa

SEQ ID NO: 6316 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactggtgctaa

SEQ ID NO: 6317 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgctggaccgaatgttgcgtctcttggcttgttacaatatcctcacttgttcagttcgtactcaacaagatggaaagattcagagactttatggtttggctactgttgctaa

SEQ ID NO: 6318 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 6319 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 6320 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccaattatgttggaccgaatgttgcgtctcttggcttgttacaatatcctcacttgttcagttcgtactcaacaagatggaaagattcagagactttatggtttggctactgttgctaa

SEQ ID NO: 6321 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatacaccagttatgttggaccgaatgttgcgtctcttggcttgttacaatatcctcacttgttctgttcgtactcaacaagatggaaaggttcagagactttatggtttggctactgttgctaa

SEQ ID NO: 6322 - DNA, 360 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgacgcaccagttatgttggaccgaatgttgcgtctcttggcttgttacaatatcctcacttgttcagttcgtactcaacaagatggaaaggttcagagactttatggtttggctactgttgcta

SEQ ID NO: 6323 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccccgatgcaccagttatgttggaccgaatgttgcgtctcttggcttgttacaatatcctcacttgttcagttcgtactcaacaagagggaaagattcagagactttatggtttggctactgttgctaa

SEQ ID NO: 6324 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctatcaacaactaaccctgatgcaccagttatgtggaaccgaattttgcgtctcgtggcttgttacaatatcctcacttgtgcaggtcgtcctcaacaagagggaaagattcagagactttatggtttggctactgttactaa

SEQ ID NO: 6325 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgttgcaccagttatgttggaccgaatgttgcgtctcttggcttgttacaatatcctcacttgttcagttcgtactcaacaagatggaaaggttcagagactttatggtttggctactgttgctaa

SEQ ID NO: 6326 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6327 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6328 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6329 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 6330 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagcctttatggtttggctactggtgctaa

SEQ ID NO: 6331 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcctggcttgttacaatatcctcacttgttcagttcgtactcaacaagatggaaaggttcagagactttatggtttggctactgttgctaa

SEQ ID NO: 6332 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 6333 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 6334 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccaaatgttgcgtctcttggcttgttacaatatcctcacttgttctgttcgtactcaacaagatggaaaggttcagagactttatggtttggctactgttgctaa

SEQ ID NO: 6335 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaaaatggaaaggttcagagactttatggtttggctactgttgctaa

SEQ ID NO: 6336 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgtgtctcttggcttgttacaatatcctcacttgttcagttcgtactcaacaagatggaaagattcagagactttatggtttggctactgttgctaa

SEQ ID NO: 6337 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgtgtctcttggcttgttacaatatcctcacttgttcagttcgtactcaacaagatggaaaggttcagagactttatggtttggctactgttgctaa

SEQ ID NO: 6338 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtacccaacaagatggaaagattcagagactttatggtttggctactgttgctaa

SEQ ID NO: 6339 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcccttgttcagttcgtactcaaccagatggaaaggttcagagactttatggtttggctactgttgctaa

SEQ ID NO: 6340 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaatatggaaaggttcagagactttatggtttggctactgttgctaa

SEQ ID NO: 6341 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 6342 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaccaagatggaaagattcagagactttatggtttggctactgttgctaa

SEQ ID NO: 6343 - DNA, 360 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgtgctaa

SEQ ID NO: 6344 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagctatgttggaccgaatgttgcgtctcttggcttgttacaatatcctcacttgttcagttcgtactcaacaagatggaaagattcagagactttatggtttggctactgttgctaa

SEQ ID NO: 6345 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccccgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6346 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcccccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6347 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctatcgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6348 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaattacacctattgtaattgcatctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6349 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctaaaatttcacctattgaaattgcttctcagctcccaacaactaaccctgatgcaccagttatgttgaaccgaatgttgcgtctcttggcttgttacaatatcctcacttgttcagttcgtactcaacaagatggaaaggttcagagactttatggtttggctactgttgctaa

SEQ ID NO: 6350 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtactcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6351 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctagtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6352 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctgaacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6353 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctagacctggtgctcaaatttcacctattgaaattgcttctcagctcccaacaactaaccctgatgcaccagttatgttggaccgaatgttgcgtctcttggcttgttacaatatcctcacttgttcggttcgtactcaacaagatggaaagattcagagactttatggtttggctactgttgctaa

SEQ ID NO: 6354 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagccggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6355 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaaccattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6356 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatcacttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtacgcaacaagatggaaaggttcagagactttatggtttggctactgttgctaa

SEQ ID NO: 6357 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaactcgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 6358 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacctgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6359 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctctcgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6360 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcgtgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagattgaaaagttcagagactttatggtttggctactgttgctaa

SEQ ID NO: 6361 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcatgaacttgatctcttagaaatcattgctaaagctggacctggtgctcaaattttacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6362 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgatttcaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6363 - DNA, 360 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgatttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6364 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccatgattctaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6365 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcttcccataattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtcgcttggcttgttacaatatcctcacttgttcagttcgtactcaacaagatggaaaggttcagagactttatggtttggctactgttgctaa

SEQ ID NO: 6366 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttctccccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6367 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagttcctcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6368 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcttcagctcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6369 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgcatcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6370 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtgattcagttcatcccatgattttaaattcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6371 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagtacttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6372 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagcgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6373 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaagcgcttcagttcttcccatgattttaaaatcagctcttgaacttgatctcttagaaatcattgctaaagctggacctcgtgctcaaatttcacctattgaaattgcttctcagctcccaacaactaaccctgatgcaccagttatgttggaccgaatgttgcctctattggcttgttacaatatcctcacttgttcagttcttgctcaacaagatggaaagattcagagactttatggtttggctactgttgctca

SEQ ID NO: 6374 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaaatgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6375 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaaatgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6376 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattagcaaatgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6377 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaattaacaaatgcttcagttcttcccatgattttaaaatcagctcttgtacttgatctcttataaatcattgctaaagctagacctggtgctcaaatttcacctattgaaattgcttctcagctcccaacaaccaaccctgatgcaccagttatgttggaccgaatgttgcctctcttggcttgttacaatatcctcccttgttcaggtcctactcaacaagatggaaaggttcagagactttatggtttggctactgttgctaa

SEQ ID NO: 6378 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaataagcaagggcttcagttcttcccatgattttaaaatcagctcttgaacttgatctcttagaaataattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 6379 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgctttagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6380 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttgagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtcctcaacaagatggaaagattcagagactttatggtttggctactgttgctaa

SEQ ID NO: 6381 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatggttttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6382 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaagtcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6383 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgagcttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6384 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaactttatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6385 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgctctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6386 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatttcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6387 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagagatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6388 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctagagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6389 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctacagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6390 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctacagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6391 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctacagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6392 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctacagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6393 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctacagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 6394 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaacgctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 6395 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagttggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6396 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctgggcctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6397 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggccatggtgctcaaatttcacctattgaaattgcttctcagctcccaacaactaaccctgatgcaccagttatgttggaccgaatgttgcgtctcttgtcttgttacaatatcctcacatgttctgttcgtactcaacaagatggaaagattcagagactttatggcttggctactggtgctaa

SEQ ID NO: 6398 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgttcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6399 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaactttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6400 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaattttacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6401 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacgtattgaaattgcttctcagctaccaacaactaaccctgatgcaccagttatgttggaccgaatgttgcgtctcttggcttgttacaatatcctcacttgttctgttcgtacccaacaagatggaaaggttcagagactttatggtttggctactgttgctaa

SEQ ID NO: 6402 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6403 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6404 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 6405 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 6406 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggtttgttacaatatcctcacttgttcagttcgtactcaacaagatggaaaggttcagagactttatggtttggctactgttgctaa

SEQ ID NO: 6407 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 6408 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 6409 - DNA, 360 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctctgttgctaa

SEQ ID NO: 6410 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 6411 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggactgaatgttgcgtctcttggcttgttacaatatcctcacttgttcagttcgtactcaacaagatggaaagattcagagactttatggtttggctactgttgctaa

SEQ ID NO: 6412 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6413 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6414 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaacttgcttctcagctaccaacaactaaccctgatgcaccagttatgttggaccgaatgttgcgtcacttggcttgttgcaatatcctcacttgttcagttcgtactcaacaagatggaaagattcagagactttagggtttggctactgttgctaa

SEQ ID NO: 6415 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcggctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6416 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 6417 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 6418 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 6419 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcggttcgtactcaacaagatggaaaggttcagagactttatggtttggctactgttgctaa

SEQ ID NO: 6420 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcctaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6421 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccgacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6422 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttgtgttggaccgaatgttgcgtctcttgacttgttacaatatcctcacttgttcagttcgtactcaacaagatggaaaggttcagagactttatggtttggctactgttgctaa

SEQ ID NO: 6423 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6424 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6425 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6426 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgctcagttcgtactcaacaagatggaaaggttcagagactttatggtttggctactgttgctaa

SEQ ID NO: 6427 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttgtggtttggctactgttgctaa

SEQ ID NO: 6428 - DNA, 360 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgatacaatatcctcacttgttcagttcgtactcaacaagatggaaagattcagagactttatggtttggctactgttctaa

SEQ ID NO: 6429 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 6430 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 6431 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 6432 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgtcgcgtctcttggcttgttacaatatcctcacttgttcagttcgtactcaacaagatggaaaagttcagagactttatggtttggctactgttgctaa

SEQ ID NO: 6433 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacagtatcctcacttgttcagttcgtactcaacaagatggaaaggttcagagactttatggtttggctactgttgctaa

SEQ ID NO: 6434 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagacgttatggtttggctactgttgctaa

SEQ ID NO: 6435 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagcctttatggtttggctactgttgctaa

SEQ ID NO: 6436 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaataagatggaaaggttcagagactttatggtttggctactgttgctaa

SEQ ID NO: 6437 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgtgtctcttggcttgttacaatatcctcacttgttcagttcgtactcaacaagatggaaaggttcagagcctttatggtttggctactgttgctaa

SEQ ID NO: 6438 - DNA, 360 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggcccgaatgttgcgtctcttggcttttaccaatatcctcacttgttaatttcgtctcaaacagatggaaaggttcagagactttatggtttggctactgttgctaa

SEQ ID NO: 6439 - DNA, 362 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgcttaa

SEQ ID NO: 6440 - DNA, 360 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcccacttgttcagttcgtactcaacaagatggaaagattcagagactttatggtttggctactgttgctaa

SEQ ID NO: 6441 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggctttttacaatatcctcacttgttcagttcgtactcaacaagatggaaaggttcagagactttatggtttggctactgttgctaa

SEQ ID NO: 6442 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 6443 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 6444 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctcatgcaccagttatgttggaccgaatgttgcgtctcttggcttgttacaatatcctcacttgttcagttcgtactcaacaagatggaaagattcagagactttatggtttggctactgttgctaa

SEQ ID NO: 6445 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccccgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6446 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaccaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6447 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccagcaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6448 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6449 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaatcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6450 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgtaccagttatgttggaccgaatgttgcgtctcttggcttgttacaatatcctcacttgttcagttcgtactcaacaagatggaaaggttcagagactttatggtttggctactgttgctaa

SEQ ID NO: 6451 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttgtaccgaatgttgcgtctcttggcttgttacaatatcctcacttgttcagttcgtactcaacaagatggaaaagttcagagactttatggtttggctactgttgctaa

SEQ ID NO: 6452 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttgtaccgaatgttgcgtctcttggcttgttacaatatcctcacttgttcagttcgtactcaacaagatggaaaggttcagagactttatggtttggctactgttgctaa

SEQ ID NO: 6453 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcccttgttcagttcgtactcaacaagatggaaaagttcagagactttatggtttggctactgttgctaa

SEQ ID NO: 6454 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6455 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6456 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacgatatcctcacttgttcagttcgtactcaacaagatggaaagattcagagactttatggtttggctactgttgctaa

SEQ ID NO: 6457 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgctgctaa

SEQ ID NO: 6458 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6459 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggccactgttgctaa

SEQ ID NO: 6460 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 6461 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgtgacaatatcctcacttgttcagttcgtacgcaacaagatggaaaagttcagagactgtatggtttggctactgttgctaa

SEQ ID NO: 6462 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactgtatggtttggctactgttgctaa

SEQ ID NO: 6463 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatttcctcacttgttcagttcgtactcaacaagatggaaaggttcagagactttatggtttggctactgttgctaa

SEQ ID NO: 6464 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgtccagttcgtactcaacaagatggaaaggttcagagactttatggtttggctactgttgctaa

SEQ ID NO: 6465 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttagtactcaacaagatggaaaggttcagagactttatggtttggctacggttgctaa

SEQ ID NO: 6466 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcatttgttcagttcgtactcaacaagatggaaaggttcagagactttatggtttggctactgttgctaa

SEQ ID NO: 6467 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttgacttgttacaatatcctcacttgttcagttcgtactcaacaagatggaaagattcagagactttatggtttggctactgttgctaa

SEQ ID NO: 6468 - DNA, 360 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 6469 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 6470 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgtcgcgtctcttggcttgttacaatatcctcacttgttcagttcgtactcaacaagatggaaaggttcagagactttatggtttggctactgttgctaa

SEQ ID NO: 6471 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccaaatgttgcgtctcttggcttgttacaatatcctcacttgttcagttcgtactcaacaagatggaaaagttcagagactttatggtttggctactgttgctaa

SEQ ID NO: 6472 - DNA, 360 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgtaa

SEQ ID NO: 6473 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcatggctggttacaatatccgcacttgttcagttcgtactcaacaagatggaaagattcagagacattatggtttggctactgttgctaa

SEQ ID NO: 6474 - DNA, 360 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgtcgcta

SEQ ID NO: 6475 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttgacttgttacaatatcctcacttgttcagttcgtactcaacaagatggaaaagttcagagactttatggtttggctactgttgctaa

SEQ ID NO: 6476 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgagtctcttggcttgtaacaatatcctcacttgttcagttcgtactcaacaatatggaaaagttcagagactttatggttggccgactgttgctaa

SEQ ID NO: 6477 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcatctcttggcttgttacaatatcctcacttgttcagttcgtactcaacaagatggaaaggttcagagactttatggtttggctactgttgctaa

SEQ ID NO: 6478 - DNA, 360 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttgctactgttgctaa

SEQ ID NO: 6479 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcctggcttgttacaatatcctcacttgttcagttcgtactcaacaagatggaaaggttcagagactttatggtttggctactgttgctaa

SEQ ID NO: 6480 - DNA, 352 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctaacttgttcagttcgtactcaacaagatggaaagattcagagactttatggtttggctac

SEQ ID NO: 6481 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgcctcttggcttgttacaatatcctcacttgttcagttcgtactcaacaagatggaaaggttcagagactttatggtttggctactgttgctaa

SEQ ID NO: 6482 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcactggttcagttcgtactcaacaagatggaaaggttcagagactttatggtttggctactgttgctaa

SEQ ID NO: 6483 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaatatggaaaggttcagagactttatggtttggctactgttgctaa

SEQ ID NO: 6484 - DNA, 360 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgcta

SEQ ID NO: 6485 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgttctcaaccagatggaaaggttcagagactttatggtttggctactgttgctaa

SEQ ID NO: 6486 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttattgtttggctactgttgctaa

SEQ ID NO: 6487 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctctgggcttgttacaatatcctcacttgttcagttcgtactcaacaagatggaaaggttcagagactttatggtttggctactgttgctaa

SEQ ID NO: 6488 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctattggcttgttacaatatcctcacttgttcagttcgtactcaacaagatggaaaagttcagagactttatggtttggctactgttgctaa

SEQ ID NO: 6489 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttagggtttggctactgttgctaa

SEQ ID NO: 6490 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 6491 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccaattatgttggaccgaatgttgcgtctcttggcttgttacaatatcctcacttgttcagttcgtactcaacaagatggaaaggttcagagactttatggtttggctactgttgctaa

SEQ ID NO: 6492 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacccattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6493 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgatcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6494 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtcctcaaatttcacctattgaaattgcttctcagctaccaacaactaaccctgatgcaccagttattttgaaccgaatgtttcgtctcttgacttattacaatatcctcacttgttcatttcttactcaacaatattaaaaatttcagacactttatggtttgactactgttcctaa

SEQ ID NO: 6495 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtactcaaatttcacctattgaaattgcttctcagctcccaacaactaaccctgatgcaccagttatgttggaccgaatgttgcgtctcttggcttgttacaatatcctcacttgttcagttcgtactcaacaagattgaaaggttcagagactttatggtttggctactgttgctaa

SEQ ID NO: 6496 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtactcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6497 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctagtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6498 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctagacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6499 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6500 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcactgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6501 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctctcagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 6502 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatcccttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6503 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttaatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6504 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaactcgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6505 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctctcgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6506 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcatgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6507 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttgaaataagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6508 - DNA, 360 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6509 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttaaaatcagctcttgaacttgatctcttagaaatcattgctaaagctggacctgttgcccaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6510 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6511 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6512 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 6513 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 6514 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 6515 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaagttcagagactttatggtttggctactgttgctaa

SEQ ID NO: 6516 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgctccagttatgttggaccgaatgttgcgtctcttggcttgttacaatatcctcacttgttcagttcgtactcaacaagatggaaagattcagagactttatggtttggctactgttgctaa

SEQ ID NO: 6517 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6518 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6519 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6520 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 6521 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6522 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6523 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6524 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatcttgcgtctcttggcttgttacaatatcctcacttgttcagttcgtactcaacaagatggaaagattcagagactttatggtttggctactgttgctaa

SEQ ID NO: 6525 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcccttgttcagttcgtactcaacaagatggaaaggttcagagactttatggtttggctactgttgcaaa

SEQ ID NO: 6526 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagtccgtactcaacaagatggaaagattcagagactttatggtttggctactgttgctaa

SEQ ID NO: 6527 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6528 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtcacttggcttgttacaatatcctcacttgttcagttcgtactcaacaagacggaaaggttcagagactttatggtttggctactgttgctaa

SEQ ID NO: 6529 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6530 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaataagatggaaaggttcagagactttatggtttggctactgttgctaa

SEQ ID NO: 6531 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6532 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagtgactttatggtttggctactgttgctaa

SEQ ID NO: 6533 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagtacgtactcaacaagatggaaaagttcagagactttatggtttggctactgttgctaa

SEQ ID NO: 6534 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctattgttgctaa

SEQ ID NO: 6535 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggacctaatgttgcgtctcttggcttgttacaatatcctcacttgttcagttcgtactcaacaagatggaaagattcagagactttatggtttggctactgttgctaa

SEQ ID NO: 6536 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttccgagactttatggtttggctactgttgctaa

SEQ ID NO: 6537 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 6538 - DNA, 360 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 6539 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 6540 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattaaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6541 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttaaaatcagctcttgaacttgatctcttagaaatcattgctaaagctgcacctggtgctcaaatttcacctattgaaattgcttctcagctaccaacaactaaccctgatgcaccagttatgttggactgaatgttgcgtctcttggcttgttacaatatcctcacttgttcagttcgtactcaacaagatggaaaggttcagagactttatggtttggctactgttgctaa

SEQ ID NO: 6542 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgattttaaaatcagctcttgaacttgacctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6543 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgatttcaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6544 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgactttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6545 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgcttcagttcttcccatgactttgaaatcagctcttgaacttgatctcttagaaatcattgctaaagctagacctggagctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6546 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaagtgctccagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6547 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactagcaaatgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6548 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccatgcaactaacaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6549 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccacgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6550 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccacgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6551 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccacgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6552 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccacgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6553 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcgccaagcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6554 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctcttcaccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6555 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaacctctacgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6556 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaaactcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6557 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaaactcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6558 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaaactcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6559 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaaactcttcgccatgcaattagcaagtgcttcagttcttcccatgattttaaaatcagctcttgaacttgatctcttagaaatcattgctaaagctggacctggtgctcaaatttcacctattgaaagtgcgtctcagctaccaacaactaaccctgatgcaccaggtaggggggaccgaatgttgcggcgcggggcgggggacaagatcctcacgggggcagggcggactcaacaagatggaaaggggcagagacttgagggcgtggctactgttgctaa

SEQ ID NO: 6560 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaaactcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6561 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagcaaaactcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcgacaagatggaaaggttcagagactttatggtttggctactgttgctaa

SEQ ID NO: 6562 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaagaaaacctcttcgccatgcaattagaaaatgcttcacttcttctcatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6563 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaaacaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6564 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaagaaacaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6565 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagatgaaaaagcaaacctcttcgccatgcaactagcaagtgcttcagttctccccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6566 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcagaggaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcggttcgtactcaacaagatggaaaggttcagagactttatggtttggctactgttgctaa

SEQ ID NO: 6567 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacatatcaaatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttatcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6568 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacataacagatgaagaagcaaaccactccgctatgcaattagcctaggcttcagttcttcccatgattttaaaatcaactcttgaactggatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6569 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccacagatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcatcaagatggaaaggttcagagactttttggtttggctactgttgctaa

SEQ ID NO: 6570 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccaaatatcagatgaagaagaaaacctcttcgccatgcaattagaaagtgattcagttcttcccatgattttaaaatcagctcttgaacttgatctcttagaaatcattgctaaagctggacctggtgctcaaatttcacctattgaaattgcttctcagctcccaacaactaaccctgattcaccagttatgtttgaccgaatgttgcgtctcttggcttgttacaatatcctcactttttcagttcgtactcaacaagattgaaagattcagagactttatggtttggctactgttgctaa

SEQ ID NO: 6571 - DNA, 361 bp, Artificial
  MsCOMT deletion introduced by TALEN pair MsCOMT_T01.1
tctcacaaaaacctcatcaatcacaaccatgggttcaacaggtgaaactcaaataaacccaaataacagatcaagtaacaaacctcttcgccacgcaactagaatgtccttcagttcttctcatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6572 - DNA, 365 bp, Artificial
  MsCOMT deletion introduced by TALEN pair MsCOMT_T01.1
tctcacaaaaacctcatcaatcacaaccatgggttcaacaggtgaaactcaaataaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 6573 - DNA, 365 bp, Artificial
  MsCOMT deletion introduced by TALEN pair MsCOMT_T01.1
tctcacaaaaacctcatcaatcacaaccatgggttcaacaggtgaaactcaaataaaccaacccacatatcagatgaagaagaaaaccttttcgccatgcaattaacaagggcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6574 - DNA, 361 bp, Artificial
  MsCOMT deletion introduced by TALEN pair MsCOMT_T01.1
tctcacaaaaacctcatcaatcacaaccatgggttcaacaggtgaaactcaaataaaccaacatatcagatgaagaagcaaaccttttcgccatgcaactagcaagtccttcagttcttcccatgattttgaaatcagctcttgaacttgatctcttagaaatcattgctaaagctggacctggtgctcaaatttcacctattgaaattgcttctcagctaccaacaacgaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6575 - DNA, 364 bp, Artificial
  MsCOMT deletion introduced by TALEN pair MsCOMT_T01.1
tctcacaaaaacctcatcaatcacaaccatgggttcaacaggtgaaactcaaataaacaacccacttatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6576 - DNA, 364 bp, Artificial
  MsCOMT deletion introduced by TALEN pair MsCOMT_T01.1
tctcacaaaaacctcatcaatcacaaccatgggttcaacaggtgaaactcaaataaacaacccacatatcagatgaagaagccaacctcttcgccattcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 6577 - DNA, 364 bp, Artificial
  MsCOMT deletion introduced by TALEN pair MsCOMT_T01.1
tctcacaaaaacctcatcaatcacaaccatgggttcaacaggtgaaactcaaataaacaacccacatatcagatgaagaagccaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6578 - DNA, 364 bp, Artificial
  MsCOMT deletion introduced by TALEN pair MsCOMT_T01.1
tctcacaaaaacctcatcaatcacaaccatgggttcaacaggtgaaactcaaataaacaacccacatatcagatgaagaagccaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6579 - DNA, 364 bp, Artificial
  MsCOMT deletion introduced by TALEN pair MsCOMT_T01.1
tctcacaaaaacctcatcaatcacaaccatgggttcaacaggtgaaactcaaataaacaacccacatatcagatgaagaagccaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcatttgttcagttcgtactcaacaagatggaaagattcagagactttatggtttggctactgttgctaa

SEQ ID NO: 6580 - DNA, 364 bp, Artificial
  MsCOMT deletion introduced by TALEN pair MsCOMT_T01.1
tctcacaaaaacctcatcaatcacaaccatgggttcaacaggtgaaactcaaataaacaacccacatatcagatgaagaagccaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 6581 - DNA, 364 bp, Artificial
  MsCOMT deletion introduced by TALEN pair MsCOMT_T01.1
tctcacaaaaacctcatcaatcacaaccatgggttcaacaggtgaaactcaaataaacaacccacatatcagatgaagaagccaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6582 - DNA, 364 bp, Artificial
  MsCOMT deletion introduced by TALEN pair MsCOMT_T01.1
tctcacaaaaacctcatcaatcacaaccatgggttcaacaggtgaaactcaaataaacaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6583 - DNA, 364 bp, Artificial
  MsCOMT deletion introduced by TALEN pair MsCOMT_T01.1
tctcacaaaaacctcatcaatcacaaccatgggttcaacaggtgaaactcaaataaacaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6584 - DNA, 364 bp, Artificial
  MsCOMT deletion introduced by TALEN pair MsCOMT_T01.1
tctcacaaaaacctcatcaatcacaaccatgggttcaacaggtgaaactcaaataaacaacccacatatcagatgaagaagcaaacctcttcgccattcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgcaaa

SEQ ID NO: 6585 - DNA, 364 bp, Artificial
  MsCOMT deletion introduced by TALEN pair MsCOMT_T01.1
tctcacaaaaacctcatcaatcacaaccatgggttcaacaggtgaaactcaaataaacaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6586 - DNA, 364 bp, Artificial
  MsCOMT deletion introduced by TALEN pair MsCOMT_T01.1
tctcacaaaaacctcatcaatcacaaccatgggttcaacaggtgaaactcaaataaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6587 - DNA, 364 bp, Artificial
  MsCOMT deletion introduced by TALEN pair MsCOMT_T01.1
tctcacaaaaacctcatcaatcacaaccatgggttcaacaggtgaaactcaaataaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6588 - DNA, 364 bp, Artificial
  MsCOMT deletion introduced by TALEN pair MsCOMT_T01.1
tctcacaaaaacctcatcaatcacaaccatgggttcaacaggtgaaactcaaataaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctctcggcttgttacaatatcctcacttgttcagttcgtactcaacaagatggaaaagttcagagactttatggtttggctactgttgctaa

SEQ ID NO: 6589 - DNA, 363 bp, Artificial
  MsCOMT deletion introduced by TALEN pair MsCOMT_T01.1
tctcacaaaaacctcatcaatcacaaccatgggttcaacaggtgaaactcaaataaacaacccacatatcagatgaagaagcaaacctcttcgccatgcaactagcaagtgcttcagttcttcccatgattttggaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 6590 - DNA, 364 bp, Artificial
  MsCOMT deletion introduced by TALEN pair MsCOMT_T01.1
tctcacaaaaacctcatcaatcacaaccatgggttcaacaggtgaaactcaaataaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6591 - DNA, 364 bp, Artificial
  MsCOMT deletion introduced by TALEN pair MsCOMT_T01.1
tctcacaaaaacctcatcaatcacaaccatgggttcaacaggtgaaactcaaataaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatgtaaagattcagagactttatggtttggctactgttgctaa

SEQ ID NO: 6592 - DNA, 364 bp, Artificial
  MsCOMT deletion introduced by TALEN pair MsCOMT_T01.1
tctcacaaaaacctcatcaatcacaaccatgggttcaacaggtgaaactcaaataaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6593 - DNA, 364 bp, Artificial
  MsCOMT deletion introduced by TALEN pair MsCOMT_T01.1
tctcacaaaaacctcatcaatcacaaccatgggttcaacaggtgaaactcaaataaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6594 - DNA, 364 bp, Artificial
  MsCOMT deletion introduced by TALEN pair MsCOMT_T01.1
tctcacaaaaacctcatcaatcacaaccatgggttcaacaggtgaaactcaaataaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6595 - DNA, 364 bp, Artificial
  MsCOMT deletion introduced by TALEN pair MsCOMT_T01.1
tctcacaaaaacctcatcaatcacaaccatgggttcaacaggtgaaactcaaataaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6596 - DNA, 364 bp, Artificial
  MsCOMT deletion introduced by TALEN pair MsCOMT_T01.1
tctcacaaaaacctcatcaatcacaaccatgggttcaacaggtgaaactcaaataaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattccgagactttatggtttggctactgttgctaa

SEQ ID NO: 6597 - DNA, 364 bp, Artificial
  MsCOMT deletion introduced by TALEN pair MsCOMT_T01.1
tctcacaaaaacctcatcaatcacaaccatgggttcaacaggtgaaactcaaataaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcgtggcttgttacaatatcctcacttgttcagttcgtactcaacaaggtggaaaggttcagagactttatggtttggctactgttgctaa

SEQ ID NO: 6598 - DNA, 364 bp, Artificial
  MsCOMT deletion introduced by TALEN pair MsCOMT_T01.1
tctcacaaaaacctcatcaatcacaaccatgggttcaacaggtgaaactcaaataaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 6599 - DNA, 364 bp, Artificial
  MsCOMT deletion introduced by TALEN pair MsCOMT_T01.1
tctcacaaaaacctcatcaatcacaaccatgggttcaacaggtgaaactcaaataaacaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 6600 - DNA, 364 bp, Artificial
  MsCOMT deletion introduced by TALEN pair MsCOMT_T01.1
tctcacaaaaacctcatcaatcacaaccatgggttcaacaggtgaaactcaaataaacaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6601 - DNA, 364 bp, Artificial
  MsCOMT deletion introduced by TALEN pair MsCOMT_T01.1
tctcacaaaaacctcatcaatcacaaccatgggttcaacaggtgaaactcaaataaacaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcatcagttatgttggaccgaatgttgcgtctcttggcttgttacaatatcctcacttgttcagttcgtactcaacaagatggaaagattcagagactttatggtttggctactgttgctaa

SEQ ID NO: 6602 - DNA, 364 bp, Artificial
  MsCOMT deletion introduced by TALEN pair MsCOMT_T01.1
tctcacaaaaacctcatcaatcacaaccatgggttcaacaggtgaaactcaaataaacaacccacatatcagatgaagaagcaaacctcttcgccatgcaactagcaagtgcttcagttcttcccatgatttggaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6603 - DNA, 363 bp, Artificial
  MsCOMT deletion introduced by TALEN pair MsCOMT_T01.1
tctcacaaaaacctcatcaatcacaaccatgggttcaacaggtgaaactcaaataaacaacccacatatcagatgaagaagcaaacctcttcgccatgcaactagaagtgcttcagttcttcccatgattttggaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6604 - DNA, 364 bp, Artificial
  MsCOMT deletion introduced by TALEN pair MsCOMT_T01.1
tctcacaaaaacctcatcaatcacaaccatgggttcaacaggtgaaactcaaataaacaacccacatatcagatgaagaagcaaacctcttcgccatccaattagcaagtgcttcagttcttcccattattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgtgcagttcgtactcaacaagatggaaagattcagagactttatggtttggctactgttgctaa

SEQ ID NO: 6605 - DNA, 364 bp, Artificial
  MsCOMT deletion introduced by TALEN pair MsCOMT_T01.1
tctcacaaaaacctcatcaatcacaaccatgggttcaacaggtgaaactcaaataaacaacccacatatcagatgaaaaagcaaaactcttcgccatacaactagcacaagcgtcagatcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttgtggtttggctactgttgctaa

SEQ ID NO: 6606 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacctatcagatgaagaagcaaccctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6607 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacctatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactatccctgatgcaccagttatgttggaccgaatgttgcatctcttggcttgttacaatatcctcacttgttcagttcgtactcaacaagatggaaagattcagagactttatggtttggctactgttgctaa

SEQ ID NO: 6608 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacctatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6609 - DNA, 361 bp, Artificial
  MsCOMT deletion introduced by TALEN pair MsCOMT_T01.1
tctcacaaaaacctcatcaatcacaaccatgggttcaacaggtgaaactcaaataaaacccacctatcagatgaagaagcaaacctcttcgccatgcaactagcagggcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6610 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacctatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6611 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcggatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6612 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagttgaagaagcaaacctcttcgccatgcaattagcaagtgcttcagttcttcccatgattttaaaatcagctcttgaacttgatctcttagaaatcattgctaaagccggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6613 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaaggagcaaacctctttgtcatccatttaacaagcacgtcagttcgtcccatgattttaaaatcaactcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6614 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcatacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6615 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaagcctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6616 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaccctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6617 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaccctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6618 - DNA, 361 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaccctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 6619 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaccctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6620 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaccctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgttaa

SEQ ID NO: 6621 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaccctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6622 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaccctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 6623 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaccctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 6624 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaccctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6625 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaccctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6626 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaccctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6627 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaccctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaatgttcagagactttatggtttggctactgttgctaa

SEQ ID NO: 6628 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaccctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatgcaaaggttcagagactttatggtttggctactgttgctaa

SEQ ID NO: 6629 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaccctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttataatatcctcacttgttcagttcgtactcaacaagatggaaaggttcagagactttatggtttggctactgttgctaa

SEQ ID NO: 6630 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaccctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccaaatgttgcgtctcttggcttgttacaatatcctcacttgttcagttcgtactcaacaagatggaaaggttcagagactttatggtttggctactgttgctaa

SEQ ID NO: 6631 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaccctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 6632 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaccctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6633 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaccctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6634 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaccctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6635 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaccctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 6636 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaccctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttgtaccgaatgttgcgtctcttggcttgttactatgtcctcacttggtcagttcgtactcaacaagatggaaagattcagagactttatggtttggctactgttgctaa

SEQ ID NO: 6637 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaccctcttcgccatgcaattagcaagtgcttcagttcttcccatgattttaaaatcagctcttgaacttgatctcttagaaatcattgctaaagctggacctggtgctcaaatctcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6638 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaccctcttcgccatgcaattagcaagtgcttcagttcttcccatgattttaaaatcagctcttgaacttgatctcttagaaatcattgctaaagctggacctggtgcccaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 6639 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaccctcttcgccatgcaattagcaagtgcttcagttcttcccatgattttaaaatcagctctggaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6640 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaccctcttcgccatgcaattagcaagtgcgtcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6641 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaccctcttcgccatgcaattagcaagtgcctcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6642 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaccctcttcgccatgcaattagcaagtacttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6643 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaccctcttcgccatgcaactagcaagtgcttcagttcttcccatgatttttaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6644 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaccctcttcgccatgcaactagcaagtgcttcagttcttcccatgattttgaaatcagctcttgaactttatctcttagaaatcattgctaaagctggacctggtgctcaaatttcacctattgaaattgcttctcagctcccaacaactaaccctgatgcaccagttatgttggaccgaatgttgcgtctctcggcttgttacaatatcctcacttgttcagttcgtactcaacaagatggaaaggttcagagactttatggtttggctactgttgctaa

SEQ ID NO: 6645 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaccctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 6646 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaccctcttcgccatgcaactagcaagtgcttcagttcttcccatgattttgaaatcagctcttgaacttgatctcttagaaatcattgctaaagctggacctggtgctcaaatttcacctgttcaaattgcttctcagcctccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 6647 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaccctcttcgccatgcaactagcaagtgcttcagttcttcccatgattttgaaatcagctcttgaacttgatctcttagaaatcattgctaaagctggacctggtgctcaaatttcacctattgaaattgcttctgagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 6648 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaccctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6649 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaccctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6650 - DNA, 361 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaccctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttctaa

SEQ ID NO: 6651 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaccctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 6652 - DNA, 361 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaccctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 6653 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaccctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6654 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaccctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6655 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaccctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6656 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaccctcttcgccatgcaactagcaagtgcttcagttcttcccatgattttgaaatcagctcttgaacttgatctcttagaaatcattgctaaagctggacctggtgctcaaatttcacctatcgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6657 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaccctcttcgccatgcaactagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 6658 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaccctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggacctaatgttgcgtctcttggcttgttacaatatcctcacttgttcagttcgtactcaacaagatggaaaagttcagagactttatggtttggctactgttgctaa

SEQ ID NO: 6659 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaccctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6660 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaccctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 6661 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaccctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6662 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaccctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6663 - DNA, 361 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaccctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgtgctaa

SEQ ID NO: 6664 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaccctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6665 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaccctcttcgccatgcaactagcaagtgcttcagtacttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6666 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaccctcttcgccatgcaactagcaagcaattcagttcttcccatgattttgaaatcagctcttgatcttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6667 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaccctcttcgccaggcaattagcaagcgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6668 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaatctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6669 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgctatgcaactagcaagtgcttcagttcttcccatgcttttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6670 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6671 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcgattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6672 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttgaaatcagctcttgaacttgatctcttagaagtcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6673 - DNA, 361 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcgcctattgaaattgcttctcagctaccaacaactaaccctgatgcaccagttatgttggaccgattgttgcgtctcttggcttgttacaatatcctcacttgttcagttcgtactcaacaagatggaaaggttcagagactttatggtttggctactgttgcaa

SEQ ID NO: 6674 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 6675 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6676 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgtttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6677 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 6678 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgattcaccagttatgttggaccgaatgttgcgtctcttggcttgttacaatatcctcacttgttcagttcgtactcaacaagatggaaaggttcagagactttatggtttggctactgttgctaa

SEQ ID NO: 6679 - DNA, 361 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttattttggaccgaatgtggcgtctcttggcttgtaacaatatcctccttttttcagttcttattcaacaaactgaaaagattcagggccttatggtttggctactgttgctaa

SEQ ID NO: 6680 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6681 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6682 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 6683 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgtaacaatatcctcacttgttcagttcgtactcaacaagatggaaaggttcagagactttatggtttggctactgttgctaa

SEQ ID NO: 6684 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6685 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6686 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6687 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6688 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcatttcgtactcaacaagatggaaagattcagagactttatggtttggctactgttgctaa

SEQ ID NO: 6689 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctacagttgctaa

SEQ ID NO: 6690 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcggctcttggcttgttacaatatcctcacttgttcagttcgtactcaacaagatggaaaggttcagagactttatggtttggctactgttgctaa

SEQ ID NO: 6691 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 6692 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttgaaatcagctcttgaacttgatctcttagaaatcattgctaaagctggacatggtgctcaaatttcacctattgaaattgcttctcagctcccaacaactaaccctgatgcaccagttatgttggaccgaatgttgcgtctcttggcttgttacaatatcctctcttgttcagttcgtactcaacaagatggaaaggttcagagactttatggtttggctactgttgctaa

SEQ ID NO: 6693 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaattcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6694 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaagtcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6695 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctacagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6696 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagcttgacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6697 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacttggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6698 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6699 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6700 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6701 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatttttgacccaattttccgtctctttgcttgttacaatatcctcacttgttcagttcctactcaacaaaatttaaagattcaaacactttatggtttcgctactgtttctaa

SEQ ID NO: 6702 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 6703 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 6704 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactggtgctaa

SEQ ID NO: 6705 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 6706 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 6707 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6708 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6709 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatacaccagttatgttggaccgaatgttgtgtctcttggcttgttacaatatcctcacttgttcagttcgtactcaacaagatggaaaggttcagagactttatggtttggctactgttgctaa

SEQ ID NO: 6710 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6711 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6712 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6713 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgctcctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 6714 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6715 - DNA, 361 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaataaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6716 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6717 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6718 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 6719 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgtgtctcttggcttgttacaatatcctcacttgttcagttcgtactcaacaagatggaaagattcagagactttatggtttggctactgttgctaa

SEQ ID NO: 6720 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6721 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtacttaacaagatggaaagattcagagactttatggtttggctactgttgctaa

SEQ ID NO: 6722 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcatagactttatggtttggctactgttgctaa

SEQ ID NO: 6723 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggattgttacaatatcctcacttgttcagttcgtactcaacaagatggaaaggttcagagactttatggtttggctactgttgctaa

SEQ ID NO: 6724 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 6725 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgcactcaacaagatggaaaggttcagagactttatggtttggctactgttgctaa

SEQ ID NO: 6726 - DNA, 361 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttctaa

SEQ ID NO: 6727 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcggctcttggcttgttacaatatcctcccttgttcagttcgtactcaacaagatggaaaggttcagagactttatggtttggcgactgttgctaa

SEQ ID NO: 6728 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 6729 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6730 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6731 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6732 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcccttgttcagttcgtactcaacaagatggaaaggttcagagactttatggtttggctactgttgctaa

SEQ ID NO: 6733 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 6734 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcatctcttggcttgttacaatatcctcacttgttcagttcgtactcaacaagatggaaaagttcagagactttatggtttggctactgttgctaa

SEQ ID NO: 6735 - DNA, 363 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctaactgttgctaa

SEQ ID NO: 6736 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatcgtttggctactgttgctaa

SEQ ID NO: 6737 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtacgcaacaagatggaaaggttcagagactttatggtttggctactgttgctaa

SEQ ID NO: 6738 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 6739 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgtgggaccgaatgttgcgtctcttggcttgttacaatatcctcacttgttcagttcgtactcaacaagatggaaagattcagagactttatggtttggctactggtgctaa

SEQ ID NO: 6740 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagtcatgttggaccgaatgttgtgtctcttggcttgttacaatatcctcacttgttcagttcgtactcaacaagatggaaaggttcagagactttatggtttggctactgttgctaa

SEQ ID NO: 6741 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagcctttatggtttggctactgttgctaa

SEQ ID NO: 6742 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 6743 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcccccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6744 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattacttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6745 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagccggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6746 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcatagctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 6747 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagttcttcccatgattttaaaatcaactcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6748 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcttcagctcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 6749 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaattagcaagtgcctcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6750 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcctatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6751 - DNA, 361 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgatttttaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgcaa

SEQ ID NO: 6752 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgatttttaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6753 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgatttttaaatcagctcttgaacgtgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6754 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaactttatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6755 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctcaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 6756 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcgaatttcgcctattgaagttgcttctcagctaccaacaactaaccctgatgcaccagttatgttgggccgaatgttgcgtctcttggcttgttgcaatatcctcgcttgttcagttcgtactcaacaagatggaaagattcagagggtttatggtttggctactgttgctga

SEQ ID NO: 6757 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6758 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 6759 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 6760 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 6761 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6762 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 6763 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaagttcagagactttatggtttggctactgttgctaa

SEQ ID NO: 6764 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 6765 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6766 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6767 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6768 - DNA, 361 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgtaa

SEQ ID NO: 6769 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcatagactttatggtttggctactgttgctaa

SEQ ID NO: 6770 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 6771 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgtgtctcttggcttgttacaatatcctcacttgttcagttcgtactcaacaagatggaaagattcagagactttatggtttggctactgttgctaa

SEQ ID NO: 6772 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 6773 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcagcaagatggaaagattcagagactttatggtttggctactgttgctaa

SEQ ID NO: 6774 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 6775 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtacttaacaagatggaaaggttcagagactttatggtttggctactgttgctaa

SEQ ID NO: 6776 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 6777 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaactactaaccctgatgcaccagttatgttggtccgaatgttgcgtctcgtggcttgttacaatatcctcacttgttcagttcgtactcaacaagatggaaaggttcagagactttatggtttgtctactgttgctaa

SEQ ID NO: 6778 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactagccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6779 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccttgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6780 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgtaccagttatgttggaccgaatgttgcgtctcttggcttgttacaatatcctcacttgttcagttcgtactcaacaagatggaaaggttcagagactttatggtttggctactgttgctaa

SEQ ID NO: 6781 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6782 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6783 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 6784 - DNA, 361 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgtgctaa

SEQ ID NO: 6785 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaataagatggaaaggttcagagactttatggtttggctactgttgctaa

SEQ ID NO: 6786 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactgtatggtttggctactgttgctaa

SEQ ID NO: 6787 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6788 - DNA, 361 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 6789 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtacccaacaagatggaaaggttcagagactttatggtttggctactgttgctaa

SEQ ID NO: 6790 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtcgcttggcttgttacaatatcctcacttgttcagttcgtactcaacaagatggaaagattcagagactttatggtttggctactgttgctaa

SEQ ID NO: 6791 - DNA, 363 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaac

SEQ ID NO: 6792 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggcgactgttgctaa

SEQ ID NO: 6793 - DNA, 359 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgc

SEQ ID NO: 6794 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaccaagatggaaaggttcagagactttatggtttggctactgttgctaa

SEQ ID NO: 6795 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgtgtctcttggcttgttacaatatcctcacttgttcagttcgtactcaacaagatggaaaggttcagagactttatggtttggctactgttgctaa

SEQ ID NO: 6796 - DNA, 361 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaaggttgcgtctcttggcgtgttacaatatcctcacatgtgcagttcgtactcaacaagatggaaaggttcagagactttatggtttgctactggtgctaa

SEQ ID NO: 6797 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgtaacaatatcctcacttgttcagttcgtactcaacaagatggaaaggttcagagactttatggtttggctactgttgctaa

SEQ ID NO: 6798 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggactggatgtttcgtctcctggcctgttacaattacctcccttgttcagttcctacccaaccagatggaaaggttcagagactttatggtttggctactgttgctaa

SEQ ID NO: 6799 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggcttggctactgttgctaa

SEQ ID NO: 6800 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 6801 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 6802 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 6803 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatacaccagttatgttggaccgaatgttgcgtctcttggcttgttacaatatcctcacttgttcagttcgtactcaacaagatggaaaggttcagagactttatggtttggctactgttgctaa

SEQ ID NO: 6804 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcgtctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6805 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggcgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6806 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctgatgctcaactttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6807 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6808 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6809 - DNA, 361 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctctagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6810 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcctagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6811 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaactggatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6812 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6813 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 6814 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 6815 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6816 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 6817 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6818 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6819 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6820 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 6821 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgtcggaccgaatgttgcgtctcttggcttgttacaatatcctcacttgttcagttcgtactcaacaagatggaaaggttcagagactttatggtttggctactgttgctaa

SEQ ID NO: 6822 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcagcaagatggaaaggttcagagactttatggtttggctactgttgctaa

SEQ ID NO: 6823 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6824 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6825 - DNA, 361 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctatgttgctaa

SEQ ID NO: 6826 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6827 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaataagatggaaaggttcagagactttatggtttggctactgttgctaa

SEQ ID NO: 6828 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 6829 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcttcagttcttccaatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6830 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgctgcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6831 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaagtgcgtcatttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6832 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaaatgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6833 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaactagcaaatgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcatactcaacaagatggaaaggttcagagactttatggtttggctactgttgctaa

SEQ ID NO: 6834 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatgcaaccagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6835 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatacaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 6836 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccatacaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6837 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccacgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 6838 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcttcgccacgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 6839 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacctcatcgccatgcaattagcaagtgcttcagttcttcccatgattttgaaatcagctcttgaacttgatctcttagaaatcattgctaaagctggacctggtactcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6840 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacatcttcgccatgcaattagcaagtaattcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6841 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacatcttcgccatgcaattaacaagtacttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6842 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagatgaagaagcaaacatcttcgccatgcaactagtaagcacttcagttctttccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6843 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatatcagaagaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcggagactttatggtttggctactgttgctaa

SEQ ID NO: 6844 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatataagatgaagaagcaagcatcttcgccatgcaattagcaagcacttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6845 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacatataagatgaagaagcaaacatcttcgccatgcaactagcaagtgattcagttattcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 6846 - DNA, 362 bp, Artificial
  MsCOMT deletion introduced by TALEN pair MsCOMT_T01.1
tctcacaaaaacctcatcaatcacaaccatgggttcaacaggtgaaactcaaataaaacccacagatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6847 - DNA, 361 bp, Artificial
  MsCOMT deletion introduced by TALEN pair MsCOMT_T01.1
tctcacaaaaacctcatcaatcacaaccatgggttcaacaggtgaaactcaaataaaaccacatctcagatgaagtagcaaacctcttcgccatgcaattcgctaatccttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6848 - DNA, 361 bp, Artificial
  MsCOMT deletion introduced by TALEN pair MsCOMT_T01.1
tctcacaaaaacctcatcaatcacaaccatgggttcaacaggtgaaactcaaataaaaccacatatcagatcaagaagcaaacctcatcgccatgcaattaacaaaggcatcagttcatcccatgattttaaaatcagctcttgtacttgatctcttagaaatcattgctaaagctaaacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6849 - DNA, 362 bp, Artificial
  MsCOMT deletion introduced by TALEN pair MsCOMT_T01.1
tctcacaaaaacctcatcaatcacaaccatgggttcaacaggtgaaactcaaataaaaccaacatatctgttgaatgagcaaacctctctgccatgcaactagcaagcacgtcagttcttcccatgattttgaaatcagctattgaacttgatctcttagaaatcattgctaaatctggacctggtgctcaaatttcacctattcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6850 - DNA, 363 bp, Artificial
  MsCOMT deletion introduced by TALEN pair MsCOMT_T01.1
tctcacaaaaacctcatcaatcacaaccatgggttcaacaggtgaaactcaaataaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6851 - DNA, 359 bp, Artificial
  MsCOMT deletion introduced by TALEN pair MsCOMT_T01.1
tctcacaaaaacctcatcaatcacaaccatgggttcaacaggtgaaactcaaagacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccatttatgttggaccgaatgttgcgtctcttggctttttactatatcctctcttgttctgttcgtactcaacaagatggaaatgttcagagcctttatgatttggctactgttgctaa

SEQ ID NO: 6852 - DNA, 424 bp, Artificial
  MsCOMT deletion introduced by TALEN pair MsCOMT_T01.1
tctcacaaaaacctcatcaatcacaaccatgggttcaacaggtgaaactcaaagacactacttatcgccactggcagcagccactggtcacaggattagcagagcgaggtatgtaggcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6853 - DNA, 424 bp, Artificial
  MsCOMT deletion introduced by TALEN pair MsCOMT_T01.1
tctcacaaaaacctcatcaatcacaaccatgggttcaacaggtgaaactcaaagacactacttatcgccactggcagcagccactggtaacaggattatcagagcgaggtatgtaggcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6854 - DNA, 424 bp, Artificial
  MsCOMT deletion introduced by TALEN pair MsCOMT_T01.1
tctcacaaaaacctcatcaatcacaaccatgggttcaacaggtgaaactcaaagacactacttatcgccactggcagcagccactggtaacaggattagcagagcgaggtatgtaggcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6855 - DNA, 424 bp, Artificial
  MsCOMT deletion introduced by TALEN pair MsCOMT_T01.1
tctcacaaaaacctcatcaatcacaaccatgggttcaacaggtgaaactcaaagacactacttatcgccactggcagcagccactggtaacaggattagcagagcgaggtatgtaggcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6856 - DNA, 424 bp, Artificial
  MsCOMT deletion introduced by TALEN pair MsCOMT_T01.1
tctcacaaaaacctcatcaatcacaaccatgggttcaacaggtgaaactcaaagacacgacttatcgccactggcagcagcccctggtaacaggattatcagagcgaggtatgtaggcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6857 - DNA, 424 bp, Artificial
  MsCOMT deletion introduced by TALEN pair MsCOMT_T01.1
tctcacaaaaacctcatcaatcacaaccatgggttcaacaggtgaaactcaaagacacgacttatcgccactggcagcagcccctggtaacaggattatcagagcgaggtatgtaggcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6858 - DNA, 424 bp, Artificial
  MsCOMT deletion introduced by TALEN pair MsCOMT_T01.1
tctcacaaaaacctcatcaatcacaaccatgggttcaacaggtgaaactcaaagacacgacttatcgccactggcagcagcccctggtaacaggattagcagagcgaggtatgtaggcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6859 - DNA, 424 bp, Artificial
  MsCOMT deletion introduced by TALEN pair MsCOMT_T01.1
tctcacaaaaacctcatcaatcacaaccatgggttcaacaggtgaaactcaaagacacgacttatcgccactggcagcagccactggtaacaggattatcagagcgaggtatgtaggcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 6860 - DNA, 424 bp, Artificial
  MsCOMT deletion introduced by TALEN pair MsCOMT_T01.1
tctcacaaaaacctcatcaatcacaaccatgggttcaacaggtgaaactcaaagacacgacttatcgccactggcagcagccactggtaacaggattatcagagcgaggtatgtaggcaacccacatatcagatgaagaagcaaacctcttcgccatgcaactagcaagtgcttcagttcttcccatgattttgaaatcagctcttgaacttgatctcttagaaatcattgctaaagcgggacctggtgctcaaatggcacctattgaaattgcggcgcagctaccaacaactaaccctgatgcaccagttatgttggaccgaaggttgcgtctcttggcttgttacaatatcctcacttgttcagttcgtactcaacaagatggaaaggttcagagactttatggtttggctactgttgataa

SEQ ID NO: 6861 - DNA, 424 bp, Artificial
  MsCOMT deletion introduced by TALEN pair MsCOMT_T01.1
tctcacaaaaacctcatcaatcacaaccatgggttcaacaggtgaaactcaaagacacgacttatcgccactggcagcagccactggtaacaggattagcagagcgaggtatgtaggcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttctcctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6862 - DNA, 424 bp, Artificial
  MsCOMT deletion introduced by TALEN pair MsCOMT_T01.1
tctcacaaaaacctcatcaatcacaaccatgggttcaacaggtgaaactcaaagacacgacttatcgccactggcagcagccactggtaacaggattagcagagcgaggtatgtaggcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6863 - DNA, 424 bp, Artificial
  MsCOMT deletion introduced by TALEN pair MsCOMT_T01.1
tctcacaaaaacctcatcaatcacaaccatgggttcaacaggtgaaactcaaagacacgacttatcgccactggcagcagccactggtaacaggattagcagagcgaggtatgtaggcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6864 - DNA, 424 bp, Artificial
  MsCOMT deletion introduced by TALEN pair MsCOMT_T01.1
tctcacaaaaacctcatcaatcacaaccatgggttcaacaggtgaaactcaaagacacgacttatcgccactggcagcagccactggtaacaggattagcagagcgaggtatgtaggcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6865 - DNA, 423 bp, Artificial
  MsCOMT deletion introduced by TALEN pair MsCOMT_T01.1
tctcacaaaaacctcatcaatcacaaccatgggttcaacaggtgaaactcaaagacacgacttatcgccactggcagcagccactggtaacaggattagcagagcgaggtatgtaggcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgtgctaa

SEQ ID NO: 6866 - DNA, 424 bp, Artificial
  MsCOMT deletion introduced by TALEN pair MsCOMT_T01.1
tctcacaaaaacctcatcaatcacaaccatgggttcaacaggtgaaactcaaagacacgacttatcgccactggcagcagccactggtaacaggattagcagagcgaggtatgtaggcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6867 - DNA, 424 bp, Artificial
  MsCOMT deletion introduced by TALEN pair MsCOMT_T01.1
tctcacaaaaacctcatcaatcacaaccatgggttcaacaggtgaaactcaaagacacgacttatcgccactggcagcagccactggtaacaggattagcagagcgaggtatgtaggcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6868 - DNA, 424 bp, Artificial
  MsCOMT deletion introduced by TALEN pair MsCOMT_T01.1
tctcacaaaaacctcatcaatcacaaccatgggttcaacaggtgaaactcaaagacacgacttatcgccactggcagcagccactggtaacaggattagcagagcgaggtatgtaggcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6869 - DNA, 424 bp, Artificial
  MsCOMT deletion introduced by TALEN pair MsCOMT_T01.1
tctcacaaaaacctcatcaatcacaaccatgggttcaacaggtgaaactcaaagacacgacttatcgccactggcagcagccactggtaacaggattagcagagcgaggtatgtaggcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6870 - DNA, 424 bp, Artificial
  MsCOMT deletion introduced by TALEN pair MsCOMT_T01.1
tctcacaaaaacctcatcaatcacaaccatgggttcaacaggtgaaactcaaagacacgacttatcgccactggcagcagccactggtaacaggattagcagagcgaggtatgtaggcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6871 - DNA, 424 bp, Artificial
  MsCOMT deletion introduced by TALEN pair MsCOMT_T01.1
tctcacaaaaacctcatcaatcacaaccatgggttcaacaggtgaaactcaaagacacgacttatcgccactggcagcagccactggtaacaggattagcagagcgaggtatgtaggcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6872 - DNA, 424 bp, Artificial
  MsCOMT deletion introduced by TALEN pair MsCOMT_T01.1
tctcacaaaaacctcatcaatcacaaccatgggttcaacaggtgaaactcaaagacacgacttatcgccactggcagcagccactggtaacaggattagcagagcgaggaatgtaggcaacccacatatcagatgaagaagcaaacctcttcgccatgcaattagcaagggcttcagttcttcacatgattttaaaatcagctcttgaacttgatctcttagaaatcattgctaaagctggacctggtgctcaaatttctcctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6873 - DNA, 429 bp, Artificial
  MsCOMT deletion introduced by TALEN pair MsCOMT_T01.1
tctcacaaaaacctcatcaatcacaaccatgggttcaacaggtgaaactcaaacgaacggctgataggatcccccaatccctttttcactgcatccagcgcaggacgcccgccgaggcaggccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6874 - DNA, 357 bp, Artificial
  MsCOMT deletion introduced by TALEN pair MsCOMT_T01.1
tctcacaaaaacctcatcaatcacaaccatgggttcaacaggtgaaactcaaacccgcatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6875 - DNA, 358 bp, Artificial
  MsCOMT deletion introduced by TALEN pair MsCOMT_T01.1
tctcacaaaaacctcatcaatcacaaccatgggttcaacaggtgaaactcaaaccccacatatcagatgaagaagcaaacctcttcgccatgcaattatcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6876 - DNA, 358 bp, Artificial
  MsCOMT deletion introduced by TALEN pair MsCOMT_T01.1
tctcacaaaaacctcatcaatcacaaccatgggttcaacaggtgaaactcaaaccccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 6877 - DNA, 358 bp, Artificial
  MsCOMT deletion introduced by TALEN pair MsCOMT_T01.1
tctcacaaaaacctcatcaatcacaaccatgggttcaacaggtgaaactcaaaccccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6878 - DNA, 358 bp, Artificial
  MsCOMT deletion introduced by TALEN pair MsCOMT_T01.1
tctcacaaaaacctcatcaatcacaaccatgggttcaacaggtgaaactcaaaccccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6879 - DNA, 358 bp, Artificial
  MsCOMT deletion introduced by TALEN pair MsCOMT_T01.1
tctcacaaaaacctcatcaatcacaaccatgggttcaacaggtgaaactcaaaccccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6880 - DNA, 358 bp, Artificial
  MsCOMT deletion introduced by TALEN pair MsCOMT_T01.1
tctcacaaaaacctcatcaatcacaaccatgggttcaacaggtgaaactcaaaccccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 6881 - DNA, 358 bp, Artificial
  MsCOMT deletion introduced by TALEN pair MsCOMT_T01.1
tctcacaaaaacctcatcaatcacaaccatgggttcaacaggtgaaactcaaaccccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6882 - DNA, 358 bp, Artificial
  MsCOMT deletion introduced by TALEN pair MsCOMT_T01.1
tctcacaaaaacctcatcaatcacaaccatgggttcaacaggtgaaactcaaaccccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6883 - DNA, 358 bp, Artificial
  MsCOMT deletion introduced by TALEN pair MsCOMT_T01.1
tctcacaaaaacctcatcaatcacaaccatgggttcaacaggtgaaactcaaaccccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6884 - DNA, 358 bp, Artificial
  MsCOMT deletion introduced by TALEN pair MsCOMT_T01.1
tctcacaaaaacctcatcaatcacaaccatgggttcaacaggtgaaactcaaaccccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6885 - DNA, 358 bp, Artificial
  MsCOMT deletion introduced by TALEN pair MsCOMT_T01.1
tctcacaaaaacctcatcaatcacaaccatgggttcaacaggtgaaactcaaaccccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 6886 - DNA, 358 bp, Artificial
  MsCOMT deletion introduced by TALEN pair MsCOMT_T01.1
tctcacaaaaacctcatcaatcacaaccatgggttcaacaggtgaaactcaaaccccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6887 - DNA, 358 bp, Artificial
  MsCOMT deletion introduced by TALEN pair MsCOMT_T01.1
tctcacaaaaacctcatcaatcacaaccatgggttcaacaggtgaaactcaaaccccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6888 - DNA, 358 bp, Artificial
  MsCOMT deletion introduced by TALEN pair MsCOMT_T01.1
tctcacaaaaacctcatcaatcacaaccatgggttcaacaggtgaaactcaaaccccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6889 - DNA, 358 bp, Artificial
  MsCOMT deletion introduced by TALEN pair MsCOMT_T01.1
tctcacaaaaacctcatcaatcacaaccatgggttcaacaggtgaaactcaaaccccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6890 - DNA, 359 bp, Artificial
  MsCOMT deletion introduced by TALEN pair MsCOMT_T01.1
tctcacaaaaacctcatcaatcacaaccatgggttcaacaggtgaaactcaaaccccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgcttaa

SEQ ID NO: 6891 - DNA, 358 bp, Artificial
  MsCOMT deletion introduced by TALEN pair MsCOMT_T01.1
tctcacaaaaacctcatcaatcacaaccatgggttcaacaggtgaaactcaaaccccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttattgtttggctactgttgctaa

SEQ ID NO: 6892 - DNA, 358 bp, Artificial
  MsCOMT deletion introduced by TALEN pair MsCOMT_T01.1
tctcacaaaaacctcatcaatcacaaccatgggttcaacaggtgaaactcaaaccccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggacggaatgttgagactctaggcttgttacaatatcctcactattttagttcgtacgcatcaagatggaaagattctgagactttatggtttggctcctggtgctaa

SEQ ID NO: 6893 - DNA, 358 bp, Artificial
  MsCOMT deletion introduced by TALEN pair MsCOMT_T01.1
tctcacaaaaacctcatcaatcacaaccatgggttcaacaggtgaaactcaaaccccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatagaaaggttcagagactttatggtttggctactgttgctaa

SEQ ID NO: 6894 - DNA, 358 bp, Artificial
  MsCOMT deletion introduced by TALEN pair MsCOMT_T01.1
tctcacaaaaacctcatcaatcacaaccatgggttcaacaggtgaaactcaaaccccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggctcgttacaatatcctcacttgttcagttcgtactcaacaagatggaaagattcagagactttatggtttggctactgttgctaa

SEQ ID NO: 6895 - DNA, 358 bp, Artificial
  MsCOMT deletion introduced by TALEN pair MsCOMT_T01.1
tctcacaaaaacctcatcaatcacaaccatgggttcaacaggtgaaactcaaaccccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6896 - DNA, 358 bp, Artificial
  MsCOMT deletion introduced by TALEN pair MsCOMT_T01.1
tctcacaaaaacctcatcaatcacaaccatgggttcaacaggtgaaactcaaaccccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6897 - DNA, 358 bp, Artificial
  MsCOMT deletion introduced by TALEN pair MsCOMT_T01.1
tctcacaaaaacctcatcaatcacaaccatgggttcaacaggtgaaactcaaaccccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6898 - DNA, 358 bp, Artificial
  MsCOMT deletion introduced by TALEN pair MsCOMT_T01.1
tctcacaaaaacctcatcaatcacaaccatgggttcaacaggtgaaactcaaaccccacatatcagatgaagaagcaaacctcttcgccatgcaattagcaagtgcctcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6899 - DNA, 358 bp, Artificial
  MsCOMT deletion introduced by TALEN pair MsCOMT_T01.1
tctcacaaaaacctcatcaatcacaaccatgggttcaacaggtgaaactcaaaccccacatatcagatgaagaagcaaacctcttcgccatgcaactatcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 6900 - DNA, 358 bp, Artificial
  MsCOMT deletion introduced by TALEN pair MsCOMT_T01.1
tctcacaaaaacctcatcaatcacaaccatgggttcaacaggtgaaactcaaaccccacatatcagatgaagaagcaaacctcttcgccatgcaactatcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6901 - DNA, 358 bp, Artificial
  MsCOMT deletion introduced by TALEN pair MsCOMT_T01.1
tctcacaaaaacctcatcaatcacaaccatgggttcaacaggtgaaactcaaaccccacatatcagatgaagaagcaaacctcttcgccatgcaactatcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 6902 - DNA, 358 bp, Artificial
  MsCOMT deletion introduced by TALEN pair MsCOMT_T01.1
tctcacaaaaacctcatcaatcacaaccatgggttcaacaggtgaaactcaaaccccacatatcagatgaagaagcaaacctcttcgccatgcaactatcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6903 - DNA, 358 bp, Artificial
  MsCOMT deletion introduced by TALEN pair MsCOMT_T01.1
tctcacaaaaacctcatcaatcacaaccatgggttcaacaggtgaaactcaaaccccacatatcagatgaagaagcaaacctcttcgccatgcaactatcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6904 - DNA, 358 bp, Artificial
  MsCOMT deletion introduced by TALEN pair MsCOMT_T01.1
tctcacaaaaacctcatcaatcacaaccatgggttcaacaggtgaaactcaaaccccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6905 - DNA, 358 bp, Artificial
  MsCOMT deletion introduced by TALEN pair MsCOMT_T01.1
tctcacaaaaacctcatcaatcacaaccatgggttcaacaggtgaaactcaaaccccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttgggttgttacaatatcctcacttgttcagttcgtactcaacaagatggaaaggttcagagactttatggtttggctactgttgctaa

SEQ ID NO: 6906 - DNA, 358 bp, Artificial
  MsCOMT deletion introduced by TALEN pair MsCOMT_T01.1
tctcacaaaaacctcatcaatcacaaccatgggttcaacaggtgaaactcaaaccccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6907 - DNA, 358 bp, Artificial
  MsCOMT deletion introduced by TALEN pair MsCOMT_T01.1
tctcacaaaaacctcatcaatcacaaccatgggttcaacaggtgaaactcaaaccccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6908 - DNA, 358 bp, Artificial
  MsCOMT deletion introduced by TALEN pair MsCOMT_T01.1
tctcacaaaaacctcatcaatcacaaccatgggttcaacaggtgaaactcaaaccccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaaggtcagagactttatggtttggctactgttgctaa

SEQ ID NO: 6909 - DNA, 358 bp, Artificial
  MsCOMT deletion introduced by TALEN pair MsCOMT_T01.1
tctcacaaaaacctcatcaatcacaaccatgggttcaacaggtgaaactcaaaccccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6910 - DNA, 358 bp, Artificial
  MsCOMT deletion introduced by TALEN pair MsCOMT_T01.1
tctcacaaaaacctcatcaatcacaaccatgggttcaacaggtgaaactcaaaccccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttcctaa

SEQ ID NO: 6911 - DNA, 358 bp, Artificial
  MsCOMT deletion introduced by TALEN pair MsCOMT_T01.1
tctcacaaaaacctcatcaatcacaaccatgggttcaacaggtgaaactcaaaccccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 6912 - DNA, 358 bp, Artificial
  MsCOMT deletion introduced by TALEN pair MsCOMT_T01.1
tctcacaaaaacctcatcaatcacaaccatgggttcaacaggtgaaactcaaaccccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttaaggtttggctactgttgctaa

SEQ ID NO: 6913 - DNA, 358 bp, Artificial
  MsCOMT deletion introduced by TALEN pair MsCOMT_T01.1
tctcacaaaaacctcatcaatcacaaccatgggttcaacaggtgaaactcaaaccccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6914 - DNA, 357 bp, Artificial
  MsCOMT deletion introduced by TALEN pair MsCOMT_T01.1
tctcacaaaaacctcatcaatcacaaccatgggttcaacaggtgaaactcaaaccccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgtgaagttcgtaatcaacaagatggaaagattcagagactttatggtttggctactgttgtaa

SEQ ID NO: 6915 - DNA, 358 bp, Artificial
  MsCOMT deletion introduced by TALEN pair MsCOMT_T01.1
tctcacaaaaacctcatcaatcacaaccatgggttcaacaggtgaaactcaaaccccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttagtactcaacaagatggaaagattcagagactttatggtttggctactgttgctaa

SEQ ID NO: 6916 - DNA, 358 bp, Artificial
  MsCOMT deletion introduced by TALEN pair MsCOMT_T01.1
tctcacaaaaacctcatcaatcacaaccatgggttcaacaggtgaaactcaaaccccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctaagctcccaacaactaaccctgatgcaccagttatgttggaccgaatgttgcgtctcttcgcttgttacaatatcctcccttgttcagttcgtactcaacaagatggaaaggttcagagactttatggtttggctactgttactaa

SEQ ID NO: 6917 - DNA, 358 bp, Artificial
  MsCOMT deletion introduced by TALEN pair MsCOMT_T01.1
tctcacaaaaacctcatcaatcacaaccatgggttcaacaggtgaaactcaaaccccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6918 - DNA, 358 bp, Artificial
  MsCOMT deletion introduced by TALEN pair MsCOMT_T01.1
tctcacaaaaacctcatcaatcacaaccatgggttcaacaggtgaaactcaaaccccacatatcagatgaagaagcaaacctcttagccattcaactagcaagcgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6919 - DNA, 357 bp, Artificial
  MsCOMT deletion introduced by TALEN pair MsCOMT_T01.1
tctcacaaaaacctcatcaatcacaaccatgggttcaacaggtgaaactcaaacccacctatccgacgaagaagcaaacctcttaaccatgcaaccaacaaaagcatcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6920 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatgtcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6921 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcggatgaagaagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6922 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcggatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaagttcagagactttatggtttggctactgttgctaa

SEQ ID NO: 6923 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcggatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6924 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcggatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 6925 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatccgatgaagaagcaaacctcttcgccatgcaattagcaagtgcttcagttcttccaatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6926 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatccgatgaagaagcaaacctcttcgccatgcaactatcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6927 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatccgatgaagaagcaaacctcttcgccatgcaactatcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6928 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatccgataaagcagcaaacctcttcgccatgcacctcacaagagcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6929 - DNA, 356 bp, Artificial
  MsCOMT deletion introduced by TALEN pair MsCOMT_T01.1
tctcacaaaaacctcatcaatcacaaccatgggttcaacaggtgaaactcaaacccacatatcatatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggcactgttgctaa

SEQ ID NO: 6930 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcatatgaagaagcaaacctcttcgccatgcaactatcaagtgcttcagttcttcccatgattttgaaatcatctcttgaacttgatctcttataaatcattgctaaagctggacctggtgctcaaatttcacctattgaaattgcttctcagctaccaacaactaacccttatgcaccagttatgttggaccgaatgtttcatctcttggcttgttccaatatcctcacttgttcagttcgtgctcaacaagatggaaaggttcagagactttatggtttggctactgttgctaa

SEQ ID NO: 6931 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcatatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6932 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcatatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6933 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcatatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6934 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagattaataagcaaacctcttcgccctgcaattatcaagtgcttcagttcttcccatgcttttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6935 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagattaataagcaaacctcttcgccctgcaactatcaagtgcttcagttcttcccatgcttttgaaatcagctcttgaacttgatctcttagaaatcattgctaaagctggacctggtgctcaaatttcacctattgaaattgcttctcagctaccaacaactaaccctgatgtaccagttatgttggaccgaatgttgcgtctcttggcttgttacaatatcctcacttgttcagttcgtactcaacaagatggaaaggttcagagactttatggtttggctactgttgctaa

SEQ ID NO: 6936 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagattaataagcaaacctcttcgccctgcaactatcaagtgcttcagttcttcccatgcttttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6937 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagattaataagcaaacctcttcgccctgcaactagcaagtgcttcagttcttcccatgcttttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6938 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagattaataagcaaacctcttcgccctgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 6939 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagattaagaagcaaacctcttcgccctgcaattatcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6940 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagattaagaagcaaacctcttcgccatgcaattatcaagtgcttcagttcttcccatgcttttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 6941 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagattaagaagcaaacctcttcgccatgcaattatcaagtgcttcagttcttcccatgcttttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6942 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagattaagaagcaaacctcttcgccatgcaattatcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 6943 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagattaagaagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6944 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagattaagaagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6945 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagattaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6946 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagattaagaagcaaacctcttcgccatgcaattagcaagtgcttcagttcttcccatgattttaaaatcagctcttgaacttgatctcttagaaatcattgctaaagctggacctggtgatcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6947 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagattaagaagcaaacctcttcgccatgcaactatcaagtgcttcagttcttcccatgcttttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6948 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagattaagaagcaaacctcttcgccatgcaactatcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6949 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagattaagaagcaaacctcttcgccatgcaactatcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6950 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagattaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 6951 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagattaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6952 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagattaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6953 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagattaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6954 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagattaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6955 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagattaagaagcaaacctcttcgccatgcaactagcaagagcttcagttcttcccatgattttgaaatcagctcttgaacttgatctcttagaaatcattgctaaagctggacctggtgctctaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6956 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgatgaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 6957 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgatgaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6958 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgatgaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6959 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaggaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6960 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaggaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6961 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaataagcaaacctcttcgccctgcaattatcaagtgcttcaattcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 6962 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaataagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6963 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaataagcaaacctcttcgccatgcaattagtaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6964 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaataagcaaacctcttcgccatgcaattagcaagttcttcagttcctcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6965 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaataagcaaacctcttcgccatgcaattagcaagtgcttcagttcttcccatgattttaaaattagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6966 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaataagcaaacctcttcgccatgcaattagcaagtgcttcagttcttcccatgattttaaaatcagctcttgaacttgatctcttagaaatcattgctaaagctggacctggtgctcaaatttcgcctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6967 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaataagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 6968 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaataagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagcctttatggtttggctactgttgctaa

SEQ ID NO: 6969 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaataagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6970 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaataagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgtttagttcgtactcaacaagatggaaagattcagagactttatggtttggctactgttgctaa

SEQ ID NO: 6971 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaataagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgtcgcgtctcttggcttgttacaatatcctcacttgttcagttcgtactcaacaagatggaaaggttcagagactttatggtttggctactgttgctaa

SEQ ID NO: 6972 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaataagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6973 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaataagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtacccaacaagatggaaagattcagagactttatggtttggctactgttgctaa

SEQ ID NO: 6974 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaataagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6975 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaataagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6976 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaataagcaaacctcttcgccatgcaattagcaagtgcttcagttcttcccatgattttaaaaccagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6977 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaataagcaaacctcttcgccatgcaactatcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6978 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaataagcaaacctcttcgccatgcaactatcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6979 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaataagcaaacctcttcgccatgcaactatcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacgatatcctcacttgttcagttcgtactcaacaagatggaaaggttcagagactttatggtttggctactgttgctaa

SEQ ID NO: 6980 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaataagcaaacctcttcgccatgcaactagcaagtgcttcagttcttcccatgcttttgaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6981 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaataagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6982 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaataagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6983 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaataagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6984 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaataagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaacctgatgcaccagttatgttggaccgtatgttgcgtctcttggcttgttacaatatcctctgttgttaagttcgtactcaacaagatggaaattttcagagtctttattgcttggctactgttgctaa

SEQ ID NO: 6985 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaataagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6986 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaataagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6987 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaataagcaaacctcttcaccatgctactagcaagagcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6988 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagcagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6989 - DNA, 356 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcgaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 6990 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctctttgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6991 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttctccatgcaactaacaagtgcttcagttcttcccatgattttgaaatcagctcttgaacttgatctcttagaaatcattgctaaagctggacctggtgctcgaattacacctgttcaaattgcttctcagcttccaacaactaacccggatgcaccagtcatgttggacggaatggtgcgtctcttggcttgttccaatatcctcacttgttatgttcgtactcaacaagatggaaaggttcagagactttatggtgtggctactgttgctaa

SEQ ID NO: 6992 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgtcatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6993 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgtcatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6994 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccctgcaattatcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6995 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccctgcaattatcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 6996 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccctgcaattatcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6997 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccctgcaattatcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 6998 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccctgcaattatcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 6999 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccctgcaattagcaattgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7000 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccctgcaattagcaagtgcttcagttcttcccatgcttttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7001 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccctgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7002 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccctgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7003 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccctgcaattagcaagtgcttcagttcttcccatgattttaaattcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7004 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccctgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7005 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccctgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagttatgttggaccgaatgttgcgtctcttggcttgttacaatatcctctcttgttcagttcgtactcaacaagatggaaaggttcagagactttatggtttggctactgttgctaa

SEQ ID NO: 7006 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccctgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7007 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccctgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7008 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccctgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctga

SEQ ID NO: 7009 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccctgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7010 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccctgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactggtgctaa

SEQ ID NO: 7011 - DNA, 355 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccctgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttagggtttgctacgttgctaa

SEQ ID NO: 7012 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccctgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7013 - DNA, 354 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccctgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttaa

SEQ ID NO: 7014 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccctgcaactatcaagtgcttcagttcttcccatgcttttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7015 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccctgcaactatcaagtgcttcagttcttcccatgattttgaaatcagctcttgaacttgatctcttagaaatcattgctaaagctgtacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7016 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccctgcaactatcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 7017 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccctgcaactatcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7018 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccctgcaactatcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7019 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccctgcaactatcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7020 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccctgcaactatcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7021 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccctgcaactatcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaagttcagagactttatggtttggctactgttgctaa

SEQ ID NO: 7022 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccctgcaactatcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7023 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccctgcaactatcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7024 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccctgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7025 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccctgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 7026 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccctgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggctcgttacaatatcctcacttgttctgttcgtactcaacaagatggaaaggttcagagactttatggtttggctactgttgctaa

SEQ ID NO: 7027 - DNA, 356 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccctgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctatgttgctaa

SEQ ID NO: 7028 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccctgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7029 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccctgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7030 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccctgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7031 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccctgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7032 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccctgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcccttgttcagttcgtactcaacaagatggaaagattcagagactttatggtttggctactgttgctaa

SEQ ID NO: 7033 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccctgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7034 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccctgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7035 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccctgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 7036 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccctgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7037 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgtaattatcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagcctttatggtttggctactgttgctaa

SEQ ID NO: 7038 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgtaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7039 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgtaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7040 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcgactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7041 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcacctagcaagtgcttcagttcttcccatgcttttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgtggctaa

SEQ ID NO: 7042 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaatttgcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7043 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattatcaagtgcttcagttcttcccatgcttttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 7044 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattatcaagtgcttcagttcttcccatgatttttaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7045 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattatcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7046 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattatcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 7047 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattatcaagtgcttcagttcttcccatgattttgaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7048 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattatcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 7049 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattatcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7050 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattatcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7051 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattatcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7052 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattatcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7053 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattatcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 7054 - DNA, 356 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattatcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgcta

SEQ ID NO: 7055 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattatcaagtgcttcagttcttcccatgattttgaaatcagctcttgaactcgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7056 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattatcaagtgcttcagttcttcccatgattttgaaatcagatcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7057 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattatcaagtgcttcagttcttcccatgattttaacatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7058 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7059 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 7060 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 7061 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctcccagcaactaaccctgatgcaccagttatgttggaccgaatgttgcgtctcttggcttgttacaatatcctcacttgttcagttcgtactcaacaagatggaaaggttcagagactttatggtttggctactggtgctaa

SEQ ID NO: 7062 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctcccaacaactaaccctgatgtaccagttatgttggaccgaatgttgcgtctcttggcttgttacaatatcctcacttgttcagttcgtactcaacaagatggaaagattcagagactttatggtttggctactgttgctaa

SEQ ID NO: 7063 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggatcgaatgttgcgtctcttggcttgttacaatatcctcacttgttcagttcgtactcaacaagatggaaaggttcagagactttatggtttggctactgttgctaa

SEQ ID NO: 7064 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7065 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7066 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatgggaaggttcagagactttatggtttggctactgttgctaa

SEQ ID NO: 7067 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7068 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagtccgtactcaacaagatggaaaggttcagagactttatggtttggctactgttgctaa

SEQ ID NO: 7069 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7070 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 7071 - DNA, 356 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggttggctactgttgctaa

SEQ ID NO: 7072 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7073 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7074 - DNA, 356 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggcactgttgctaa

SEQ ID NO: 7075 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattatcaagtgcttcagttcttcccatgattttaaaatcagctcttgaacttgatctcttagaaatcattgctaaagctggacctggtgatcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 7076 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattatcaagtgcttcagttcttcccatgattttaaaatcagctcttgaacttgatctcttagaaatcattgctaaagctggacccggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7077 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattatcaagtgcttcagttcttcccatgattttaaaatcagctcttgaacttgatctcttagaaatcattgctaaagctgaacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7078 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattatcaagtgcttcagttcttcccatgattttaaaatcagctctcgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7079 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattatcaagtgcttcagttcttcccatgattttaaaagcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7080 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaggtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7081 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcctatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7082 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccattattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7083 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgcttttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7084 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgcttttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcatgttacaatatcctcacttgttcagttcgtactcaacaagagggaaaggttcagagactttatggtctggctactgtagctaa

SEQ ID NO: 7085 - DNA, 358 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgcttttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatgggttggctaactgttgctaa

SEQ ID NO: 7086 - DNA, 356 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgcttttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctatgttgctaa

SEQ ID NO: 7087 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgcttttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7088 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgatttttaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7089 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttgaaatcagctcttgaacttgatctcttagaaatcattgctaaagctggacctggtgctcaaattttacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7090 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 7091 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 7092 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7093 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattggaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7094 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaccaactaaccctgatgcaccagttatgttggaccgaatgttgcgtctcttggcttgttacaatatcctcacttgttcagttcgtactcaacaagatggaaagattcagagactttatggtttggctgctgttgctaa

SEQ ID NO: 7095 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7096 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7097 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgtttcgtctcttggcttgttacaatatcctcacttgttcagttcgtactcaacaagattgaaaggttcagagactttatggtttggctactgttgctaa

SEQ ID NO: 7098 - DNA, 356 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 7099 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7100 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggatactgttgctaa

SEQ ID NO: 7101 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 7102 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggacctaatcttgcgtctcttcgcttgttacaatatcctcacttgttcagttcgtactcaacaaaatggaaagtttcagagactttatggtttcgctactgttgctaa

SEQ ID NO: 7103 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7104 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7105 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7106 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagacggaaaggttcagagactttatggtttggctactgttgctaa

SEQ ID NO: 7107 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcctggcttgttacaatatcctcacttgttcagttcgtactcaacaagatggaaagattcagagactttatggtttggctactgttgctaa

SEQ ID NO: 7108 - DNA, 358 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctaactgttgctaa

SEQ ID NO: 7109 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 7110 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 7111 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttgtctactgttgctaa

SEQ ID NO: 7112 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 7113 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttgaaatcagctcttgaacttgatctcttagaaatcattgctaaagctggacctggtactcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7114 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaacatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7115 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgttctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7116 - DNA, 356 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagagatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctatgttgctaa

SEQ ID NO: 7117 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaggctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7118 - DNA, 356 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 7119 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagttggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagaaactttatggtttggctactgttgctaa

SEQ ID NO: 7120 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggtcctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7121 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctgttgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7122 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcgcctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7123 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcatctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7124 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7125 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7126 - DNA, 356 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgtaa

SEQ ID NO: 7127 - DNA, 356 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggacggaatgttccgtctcttggtttgttccaatatctcccctggttcagttcgtatccaacaagatggaaaggtccagagccttatggtttggctactgttgctaa

SEQ ID NO: 7128 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 7129 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 7130 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 7131 - DNA, 356 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgcta

SEQ ID NO: 7132 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 7133 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagcctttatggtttggctactgttgctaa

SEQ ID NO: 7134 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7135 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7136 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7137 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7138 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgtttcgtctcttggcttgttacaatatcctcacttcttcagttcgtcctcaacaagatggaaagattcagagactttatggtttggctactgttgctaa

SEQ ID NO: 7139 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttcgcagcttccaacaactaaccctgatgcaccagttatgttggaccgaatgttgcgtctcttggcttgttactatatcctctcttgttcagttcgtactcaacaagatggaaagattcagagtctttatggtttggctactgttgctaa

SEQ ID NO: 7140 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgtttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7141 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgtttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7142 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgtttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7143 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcggctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7144 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7145 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7146 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 7147 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctgccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7148 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7149 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7150 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7151 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgcactcaacaagatggaaaggttcagagactttatggtttggctactgttgctaa

SEQ ID NO: 7152 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccggatgttgcgtctcttggcttgttacaatatcctcactttttcagttcgtactcaacaaaatggaaaggttcagaggctttatggtttggctactgttgctaa

SEQ ID NO: 7153 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgtcgcgtctcttggcttgttacaatatcctcacttgttcagttcgtactcaacaagatggaaagattcagagactttatggtttggctactgttgctaa

SEQ ID NO: 7154 - DNA, 356 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactttgctaa

SEQ ID NO: 7155 - DNA, 356 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttgctactgttgctaa

SEQ ID NO: 7156 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcatcaagatggaaaagttcagagactttatggtttggctactgttgctaa

SEQ ID NO: 7157 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcgcttgttcagttcgtactcaacaagatggaaaggttcagagactttatggtttggctactgtggctaa

SEQ ID NO: 7158 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgtttcgtctcttggcttgttacaatatcctcacttgttcagttcgtactcaacaagatggaaagattcagagactttatggtttggctactgttgctaa

SEQ ID NO: 7159 - DNA, 356 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgtgctaa

SEQ ID NO: 7160 - DNA, 356 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctacgttgctaa

SEQ ID NO: 7161 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgatacaatatcctcacttgttcagttcgtactcaacaagatggaaagattcagagactttatggtttggctactgttgctaa

SEQ ID NO: 7162 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaagttcagagactttatggtttggctactgttgctaa

SEQ ID NO: 7163 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 7164 - DNA, 356 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctctgttgctaa

SEQ ID NO: 7165 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 7166 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggatactgttgctaa

SEQ ID NO: 7167 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatattgcgtctcttggcttgttacaatatcctcacttgttcagttcgtactcaacaagatggaaaggttcagagactttatggtttggctactgttgctaa

SEQ ID NO: 7168 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtctggctactgttgctaa

SEQ ID NO: 7169 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacgagatggaaaggttcagagactttatggtttggctactgttgctaa

SEQ ID NO: 7170 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcccttgttcagttcgtactcaacaagatggaaagattcagagactttatggtttggctactgttgctaa

SEQ ID NO: 7171 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatactcacttgttcagttcgtactcaacaagatggaaaggttcagagactttatggtttggctactgttgctaa

SEQ ID NO: 7172 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtcccttggcttgttacaatatcctcacttgttcagttcgtactcaacaagatggaaaagttcagagactttatggtttggctactgttgctaa

SEQ ID NO: 7173 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 7174 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcgacaagatggaaaggttcagagactttatggtttggctactgttgctaa

SEQ ID NO: 7175 - DNA, 356 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 7176 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattctgagactttatggtttggctactgttgctaa

SEQ ID NO: 7177 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttagaatatcctcacttgttcagttcgtactcaacaagatggaaagattcagagactttatggtttggctactgttgctaa

SEQ ID NO: 7178 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcatactcaacaagatggaaaggttcagagactttatggtttggctactgttgctaa

SEQ ID NO: 7179 - DNA, 356 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgtgctaa

SEQ ID NO: 7180 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactatatggtttggctactgttgctaa

SEQ ID NO: 7181 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttagaccgaatgttgcgtctcttggcttgttacaatatcctcacttgttcagttcgtactcaacaagatggaaaggttcagagactttatggtttggctactgttgctaa

SEQ ID NO: 7182 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgatggaccgaatgttgcgtctcttggcttgttacaatatcctcacttgttcagttcgtactcaacaagatggaaagattcagagactttatggtttggcgactgttgctaa

SEQ ID NO: 7183 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 7184 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 7185 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 7186 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 7187 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccaattatgttggaccgaatgttgcgtctcttggcttgttacaatatcctcacttgttcagttcgtactcaacaagatggaaaggttcagagactttatggtttggctactgttgctaa

SEQ ID NO: 7188 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcacaagttatgttggaccgaatgttgcgtctcttggcttgttacaatatcctcacttgttcagttcgtactcaacaagatggaaagattcagagactttatggtttggctactgttgctaa

SEQ ID NO: 7189 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgaagcaacagttatgttgaaccgaatgttgcgtctcttggcttgttacaatatcctcacttgttcagttcgtactcaacaagatggaaaggttcagagactttatggtttggctactgttgctaa

SEQ ID NO: 7190 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaatcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7191 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7192 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttgggccgaatgttgcgtctcttggcttgttacaatatcctcacttgttcagttcgtactcaacaagatggaaaggttcagagactttatggtttggctactgttgctaa

SEQ ID NO: 7193 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7194 - DNA, 356 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctacgttgctaa

SEQ ID NO: 7195 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7196 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7197 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 7198 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtttcttggcttgttacaatatcctcacttgttcagttcgtactcaacaagatggaaagattcagagactttatggtttggctactgttgctaa

SEQ ID NO: 7199 - DNA, 356 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 7200 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagaatttatggtttggttactgttgctaa

SEQ ID NO: 7201 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgcactcaacaagatggaaaggttcagagactttatggtttggctactgttgctaa

SEQ ID NO: 7202 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 7203 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctaccgttgctaa

SEQ ID NO: 7204 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctaatgttgctaa

SEQ ID NO: 7205 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcatctcttggcttgttacaatatcctcacttgttcagttcgtactcaacaagatggaaaggttcagagactttatggtttggctactgttgctaa

SEQ ID NO: 7206 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgctacaatatcctcacttgttcagttcgtactcaacaagatggaaaggttcagagactttatggtttggctactgttgctaa

SEQ ID NO: 7207 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatattgcgtctcttggcttgttacaatatcctcacttgttcagttcgtactcaacaagatggaaaggttcagagactttatggtttggctactgttgctaa

SEQ ID NO: 7208 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcatggcttgttacaatatcctcacttgttcagttcgtactcaacaagatggaaaggttcagagactttatggtttggctactgttgctaa

SEQ ID NO: 7209 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcactcgttcagttcgtactcaacaagatggaaaggttcagagactttatggtttggctactgttgctaa

SEQ ID NO: 7210 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatgggttggctactgttgctaa

SEQ ID NO: 7211 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcggttcgtactcaacaagatggaaaggttcagagactttatggtttggctactgttgctaa

SEQ ID NO: 7212 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggcgactgttgctaa

SEQ ID NO: 7213 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgataa

SEQ ID NO: 7214 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 7215 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccaaatgttgcgtctcttggcttgttacaatatcctcacttgttcagttcgtactcaacaagatggaaagattcagagactttatggtttggctactgttgctaa

SEQ ID NO: 7216 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaacgaatgttgcgtctcttggcttgttacaatatcctcacttgttcagttcgtactcaacaagatggaaaagttcagagactttatggtttggctactgttgctaa

SEQ ID NO: 7217 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 7218 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 7219 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccaattatgttgaaccgaatgttgcgtctcttggcttgttacaatatcctcacttgttcagttcgtactcaacaagatggaaaggttcagagactttatggtttggctactgttgctaa

SEQ ID NO: 7220 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcaactcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7221 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaactgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7222 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctatcgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7223 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatctcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7224 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgcccaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7225 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgcccaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7226 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtactcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7227 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctctcagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7228 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcctagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgtttctat

SEQ ID NO: 7229 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcatagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7230 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaactcgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7231 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaactcgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7232 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcttcccatgatcttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7233 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagttcatcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7234 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcagtccttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7235 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgcttcaattcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7236 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagtgctacagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7237 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattagcaagcgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7238 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattaccaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7239 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattaccaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 7240 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattaccaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7241 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattaccaagtgcttcaggtcttcccatgattttaaaatcagctcttgaacttgatctcttagaaatcattgctaaagctggacctggtgctcaaatttcacctattgaaattgcttctcagctaccaacatctaaccctgatgcaccagttatgttggaccgaatgttgcgtctcgtggcttgttacaatatcctcacttgttcagttcgtactcaacaagatggaaagattcagagactttatggtttggctactgttgctaa

SEQ ID NO: 7242 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattaacaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7243 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaattaacaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7244 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactatcaagtgcttcagttcttcccatgattttgacatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7245 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactatcaagtgcttcagttcttcccatgattttgaaatcagctcttgaacttgatctcttagaaatcattgctaaagctggacttggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7246 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactatcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgtggcgtctcttggcttgttacaatatcctcacttgttctggtcgtactcaacaagatggaaaggttcagagactttatggtttggctactgttgctaa

SEQ ID NO: 7247 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactatcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 7248 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactatcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7249 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactatcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7250 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactatcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7251 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactatcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 7252 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactatcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7253 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactatcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7254 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactatcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7255 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactatcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 7256 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactatcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtacacaacaagatggaaagattcagagactttatggtttggctactgttgctaa

SEQ ID NO: 7257 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactatcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcgtggcttgttacaatatcctcacttgttcagttcgtactcaacaagatggaaaggttcagagcctttatggtttggctactgttgctaa

SEQ ID NO: 7258 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactatcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 7259 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactatcaagtgcttcagttcttcccatgattttgaaatcagctcttgaacttgatctcttagaaatcattgctaaagctggacctggtgctcaaatttcacctattgaaattgcttctcagataccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7260 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactatcaagtgcttcagttcttcccatgattttgaaatcagctcttgaacttgatctcttagaaatcattgctaaagctggacctggtgctcaaatttcacctattgaaattgattctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7261 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactatcaagtgcttcagttcttcccatgattttgaaatcagctcttgaacttgatctcttagaaatcattgctaaagctggacctggtgcgcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7262 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactatcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 7263 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactatcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 7264 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactatcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7265 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactatcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7266 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactatcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtctggctactgttgctaa

SEQ ID NO: 7267 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactatcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7268 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactatcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 7269 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactatcaagtgcttcagttcttcccatgatcttgaaatcagctcttgaacttgatctcttagaaatcattgctaaagctggacctggtgctcaaatttcatctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7270 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcgagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7271 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttgttcccatgattttgaaatcagctcttgaacttgatctcttagaaatcattgctaaagctggacctggtgctcaaatttcacctatttaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7272 - DNA, 356 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgcttttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggcactggtgctaa

SEQ ID NO: 7273 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgcttttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7274 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgcttttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7275 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgctcttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctctcggcttgttacaatatcctcacttgttcagttcgtactcaacaagatggaaagattcagagactttatggtttggctactgttgctaa

SEQ ID NO: 7276 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatccgctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7277 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaactttatctcttagaaatcattgctaaagctggacctggtgctcaaatttcacctattgaaattgcttctcagctcccaacaactaaccctgatgcaccagttatgttggacctaatgtttcgtctcttggcttgttacaatatcctcacttgttcagttcgtactcaacaagatggaaaggttcagagactttatggtttggctactgttgctaa

SEQ ID NO: 7278 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaactcattgctaaagctggacctggtgctcaaatttcacctattgatattgcttctcagctaccaacaactaaccctgatgcaccagttatgttggaccgaatgttgcgtctcttggcttgttacaatatcctcacttgttcagttcgtactcaacaagatggaaaagttcagagactgtatggtttggctactgttgctaa

SEQ ID NO: 7279 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctgggcctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7280 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacttggtgctcaaatttcacctattgaaattgcttctcagctcccaacaactaaccctgatgcaccagttatgttggaccgaatgtggcgtctcttggcttgttacaatatcctcacttgttcagttcgtactcaacaagatggaaagattcagagactttatggtttggctactgttgctaa

SEQ ID NO: 7281 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaactttcgcctattgaaatttcttctcagctaccaacaactaaccctgatgcaccagttatgttggaccgaatgttgcgtcacttggcttgttacaatatcctcacttgttcagttcgtactcaacaagatggaaaggttcagagactttatggtttggctactgttgctaa

SEQ ID NO: 7282 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgttgcaccagtcatgttggaccgaatgttgcgtctcttggcttgttacaatatcctcacttgttctgttcgtactcaacaagatggaaaggttcagagactttatggtttggctactgttgctaa

SEQ ID NO: 7283 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttaaggtttggctactgttgctaa

SEQ ID NO: 7284 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7285 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7286 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 7287 - DNA, 356 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgtgctaa

SEQ ID NO: 7288 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 7289 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 7290 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 7291 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctctcttgttctgttcgtactcaacaagatggaaaggttcagagactttatggtttggctactgttgctaa

SEQ ID NO: 7292 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggttgggctactgttgctaa

SEQ ID NO: 7293 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 7294 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7295 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7296 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 7297 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7298 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgatcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7299 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattggaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7300 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattggaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 7301 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgtttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7302 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7303 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 7304 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaagttcagagactttatggtttggctactgttgctaa

SEQ ID NO: 7305 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 7306 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 7307 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttgtaccgaatgttgcgtctcttggcttgttccaatatccccacttgttcagttcgtactcaacaagatggaaaggttcagagactttatggtttggctactgttgctaa

SEQ ID NO: 7308 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttgggccgaatgttgcgtctcttggcttgttacaaaatcctcacttgttcagttcgtactcaacaagatggaaagattcagagactttatggtttggctactgttgctaa

SEQ ID NO: 7309 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggatcgaatgttgcgtctcttggcttgttacaatatcctcacttgttcagttcgtactcaacaagatggaaaggttcagagcctttatggtttggctactgttgctaa

SEQ ID NO: 7310 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7311 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7312 - DNA, 356 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcccttgttcagttcgtcctcaacaagatggaaaggttcagagacttatggtttggctactgttgctaa

SEQ ID NO: 7313 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7314 - DNA, 356 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctatgttgctaa

SEQ ID NO: 7315 - DNA, 356 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 7316 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtatcttggcttgttacaatatcctcacttgttcagttcgtactcaacaagatggaaagattcagagactttagggtttggctactgttgctaa

SEQ ID NO: 7317 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgcactcaacaagatggaaaggttcagagactttatggtttggctactgttgctaa

SEQ ID NO: 7318 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgtgtcacttggcttgttacaatatcctcacttgttcagttcgtactcaacaagatggaaagattcagagactttatggtttggctactgttgctaa

SEQ ID NO: 7319 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 7320 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttgacttgttacaatatcctcacttgttcagttcgtactcaacaagatggaaagattcagagactttatggtttggctactgttgctaa

SEQ ID NO: 7321 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgactcttggcttgttacaatatcctcacttgttcagttcgtactcaacaagatggaaagattcagagactttatggtttggctactgttgctaa

SEQ ID NO: 7322 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 7323 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 7324 - DNA, 358 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatgggtttggctactgttgctaa

SEQ ID NO: 7325 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttgcaatatcctcacttgttctgttcgtactcaacaagatggaaagattcagagactttatggtttggctactgttgctaa

SEQ ID NO: 7326 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcctggcttgttacaatatcctcacttgttcagttcgtactcaacaagatggaaaggttcagagactttatggtttggctactgttgctaa

SEQ ID NO: 7327 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacatgttcagttcgtactcaacaagatggaaagattcagagactttatggtttggctactgttgctaa

SEQ ID NO: 7328 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 7329 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 7330 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgataaaccagttatgttggaccgaatgttgcgtctcttggcttgttacaatatcctcacttgttcagttcgtactcaacaagatggaaaggttcagagactttatggtttggctactgttgctaa

SEQ ID NO: 7331 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccccgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7332 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccatcaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7333 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7334 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttttgttggaccgaatgttgcgtctcttggcttgttacaatatcctcacttgttcagttcgtactcaacaagatggaaaggttcagagactttatggtttggctactgttgctaa

SEQ ID NO: 7335 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggtccgaatgttgcgtctcttggcttgttacaatatcctcacttgttcagttcgtactcaacaagatggaaagattcagagactttatggtttggctactgttgctaa

SEQ ID NO: 7336 - DNA, 356 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttagttcgtactcaacaagatggaaagattcagagactttatggtttggctactgttgctaa

SEQ ID NO: 7337 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7338 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7339 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7340 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaggatggaaaggttcagagactttatggtttggctactgttgctaa

SEQ ID NO: 7341 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcactcgttcagttcgtactcaacaagatggaaaggttcagagactttatggtttggctactgttgctaa

SEQ ID NO: 7342 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 7343 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgctgctaa

SEQ ID NO: 7344 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgcctcttggcttgttacaatatcctcacttgttcagttcgtactcaacaagatggaaaggttcagagactttatggtttggctactgttgctaa

SEQ ID NO: 7345 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgtagcgtctctgggatgtttaaaatatcctcgcttgttcagttcgtactcaacaagaagaaaagattcgaggtctttatggtttggctactgttgctaa

SEQ ID NO: 7346 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacatgatggaaaagttcagagactttatggtttggctactgttgctaa

SEQ ID NO: 7347 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagtttgtactcaacaagatggaaaggttcagagactttatggtttggctactgttgctaa

SEQ ID NO: 7348 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtcgcttggctggttacaatagcctcacttgttctgttcgtactcaacaagatggaaaggttcagagactttatggtttggctactgttgctaa

SEQ ID NO: 7349 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggtttgttacaatatcctcacttgttcagttcgtactcaacaagatggaaaggttcagagactttatggtttggctactgttgctaa

SEQ ID NO: 7350 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttgtctactgttgctaa

SEQ ID NO: 7351 - DNA, 358 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttgggctactgttgctaa

SEQ ID NO: 7352 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgtccagttcgtactcaacaagatggaaagattcagagactttatggtttggctactgttgctaa

SEQ ID NO: 7353 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggatactgttgctaa

SEQ ID NO: 7354 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcgcttgtgcagttcgtactcaacaagatggaaaggttcagagactttatggtttgggtactgttgctaa

SEQ ID NO: 7355 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttagcttgttacaatatcctcacttgttcagttcgtactcaacaagatggaaagattcagagactttatggtttggctactgttgctaa

SEQ ID NO: 7356 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagattgaaaggttcagagactttatggtttggctactgttgctaa

SEQ ID NO: 7357 - DNA, 358 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatgggttggctactgttgcctaa

SEQ ID NO: 7358 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatgtaaaggttcagagattttatggtttggctactgttgctta

SEQ ID NO: 7359 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcgtgttacaatatcctcacttgttcagttcgtactcaacaagatggaaaggttcagagactttatggtttggctactgttgctaa

SEQ ID NO: 7360 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgtggctaa

SEQ ID NO: 7361 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgttctcaacaagctggaaagtttcagagactttatggttttgcgactgttgctaa

SEQ ID NO: 7362 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 7363 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctac

SEQ ID NO: 7364 - DNA, 356 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggtactgttgctaa

SEQ ID NO: 7365 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtcacttggcttgttacaatatcctcacttgtgcagttcgtactcaacaagaagcaaaagttcagagactgtatggtttggttgctgttgcgaa

SEQ ID NO: 7366 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 7367 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgctgctaa

SEQ ID NO: 7368 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatgcaaaggttcagagactttatggtttggctactgttgctaa

SEQ ID NO: 7369 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttagctactgttgctaa

SEQ ID NO: 7370 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagcctttatggtttggctactgttgctaa

SEQ ID NO: 7371 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggtttagagactttatggtttggctactgttgctaa

SEQ ID NO: 7372 - DNA, 356 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgtgctaa

SEQ ID NO: 7373 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcccttgttcagttcgtactcaacaagacggaaaagttcagagactttatggtttggctactgttgctaa

SEQ ID NO: 7374 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagatactttatggtttggctactgttgctaa

SEQ ID NO: 7375 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttgtcttgttacaatatcctcacttgttctgttcgtactcaacaagatggaaaggttcagagactttatggtttggctactgttgctaa

SEQ ID NO: 7376 - DNA, 356 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctatgttgctaa

SEQ ID NO: 7377 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggacccaatgttgcgtctcttggcttgttacaatatcctcacttgttcagttcgttctcaaccagatggaaaggttcagagactttatggtttggctactgttgctaa

SEQ ID NO: 7378 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttacgttggaccgaatgttgcgtctcttggcttgttacaatatcctcacttgttcagttcgtactcaacaagatggaaaggttcagagactttatggtttggctactgttgctaa

SEQ ID NO: 7379 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 7380 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 7381 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatacaccagttatgttggaccgaatgttgcgtctcttggcttgttacaatatcctcacttgttcagttcgtactcaacaagatggaaaggttcagagactttatggtttggctactgttgctaa

SEQ ID NO: 7382 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccccgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7383 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 7384 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaattccacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7385 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgcccaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7386 - DNA, 355 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtactcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggttcggcctgttgctaa

SEQ ID NO: 7387 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctgatgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7388 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacccggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7389 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctgaacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7390 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctgaacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7391 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctagacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggttttgctactgttgctaa

SEQ ID NO: 7392 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagccggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7393 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7394 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattactaaagctggacctggtgctcaaatttcacctattgaaattgcttctcagctaccaacaactaaccctgatgcaccagttatgttggactgaatgttgcgtctcttggcttgttacaatatcctcacttgttcagttcgtactcaacaagatggaaaggttcagagactttatggtttggctactgttgctaa

SEQ ID NO: 7395 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcactgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7396 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctctcagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7397 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcctagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7398 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacatgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 7399 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttgaaatcagcgcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7400 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttaaaatcagctcttgaacttgatctcttagacatcattgctaaagctggacctggtgctcaaatttcaactattgaaaatgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7401 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttaaaatcagctcttgaacttgatctcttagaaatcattgctagagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7402 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcgcctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7403 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 7404 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 7405 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaacctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 7406 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgtgtctcttggcttgttacaatatcctcacttgttcagttcgttctgaaccagatggaaaggttcagagactttatgatttggctactgtcactaa

SEQ ID NO: 7407 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7408 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 7409 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7410 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7411 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 7412 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7413 - DNA, 356 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgtgctaa

SEQ ID NO: 7414 - DNA, 356 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagctggaaagattcagagactttatggtttggctactgttgtaa

SEQ ID NO: 7415 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 7416 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactggtgctaa

SEQ ID NO: 7417 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgtggctaa

SEQ ID NO: 7418 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 7419 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgtttcgtctcttggcttgttacaatatcctcacttgttcagttcgtactcaacaagatggaaaggttcagagactttatggtttggctactgttgctaa

SEQ ID NO: 7420 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7421 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7422 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7423 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtcacttggcttgttacaatatcctcacttgttcagttcgtactcaacaagatggaaagattcagagactttatggtttggctactgttgctaa

SEQ ID NO: 7424 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtcccttggcttgttacaatatcctcacttgttcagttcgtactcaacaagatggaaaagttcagagactttatggtttggctactgttgctaa

SEQ ID NO: 7425 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 7426 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 7427 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttaaaatcagctcttgaacttgatctcttagaaatcattgctaaagctggacctggtgctaaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7428 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttaaaatcagctcttgaacttgatctcttagaaatcattgctaaagctggacctggtgatcaaatttcacctattgaaattgcttctcagctccaaacaactaaccctgatgcaccagttatgttggaccgaatgttgcgtctcttggattgttacaatatcctcacttgttcagttcgtactcaacaagatggaaagattcagagactttatggtttggcgactgttgctaa

SEQ ID NO: 7429 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttaaaatcagctcttgaacttgatctcttagaaatcattgctaaagctggacctgatgctcaaatttcacctattgaaattgcttctcagctcccaacaactaaccctgatgcaccagttatgttggaccgaatgttgcgtctcttggcttgttgcaatatcctcacttgttcagttcgtactcaacaagatggaaaggttcagagactttatggtttggctactgttgctaa

SEQ ID NO: 7430 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttaaaatcagctcttgaacttgatctcttagaaatcactgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7431 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttaaaatcagctcttgaacttaatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 7432 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattttaaaatcagctctcgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7433 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattctgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7434 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccatgattatgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 7435 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccaggattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7436 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttcttcccacgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7437 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcttcagttctccccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 7438 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcctcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7439 - DNA, 356 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtgcctcagttcttcccatgatttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7440 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagtacttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7441 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagggcttcagttcttcccatgattttgaaatcagctcttgaacttgatctcttagaaatcattgctaaagctggacctgttgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7442 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagcgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggatcgaatgttgcgtctcttggcttgttacaatatcctcacttgttcagttcgtactcaacaagatggaaaggttcagagactttatggtttggctactgttgctaa

SEQ ID NO: 7443 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaagagcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7444 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactagcaaatgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7445 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactaccaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7446 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactaacaagtgcttcagttcttcccatgcttttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 7447 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactaacaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7448 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactaacaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7449 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactaacaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7450 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactaacaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7451 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatgcaactaacaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7452 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccatacaactagcaagtgcttcagttcttcccatgattttgaaatcagctcttgaacttgatctcttagaaatcattgctaaagctggacctggtgctcaaatttcacctatcgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7453 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccacgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7454 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgccacgcaactagcaagtgcttcagttcttcccatgattttgaaatcagctcttgaacttgatctcttagaaatcattgctaaagctggacctgatgctcaaatttcacctattgaaattgcttctcagctcccaacaactaaccctgatgcatcagtcatgttggaccgaatatttcgtctcttggcttgttacaatatcctcacttgttctgttcgtactcaacaagatggaaaggttcagagactttatggtttggctactgttgctaa

SEQ ID NO: 7455 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcgcaatgcaactatcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcacagtctttatggtttggctactgttgctaa

SEQ ID NO: 7456 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcaccctgcaattatcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7457 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcaccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7458 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcaccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7459 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctcttcaccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7460 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacctattcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7461 - DNA, 356 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaacccttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7462 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagcaaaccacttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7463 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaagaaaacctcttagccatgcaattagcaagtgcttcagttcttcccatgattttgaaatcagctattgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7464 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaaacaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7465 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagatgaagaaacaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7466 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcagataaatcagaaaacctattagccatgcaattaacaagagcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7467 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcacatgaagaagcaaacctattcgccatccaatccgcaagagcatcagttcctcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7468 - DNA, 357 bp, Artificial
  MsCOMT deletion introduced by TALEN pair MsCOMT_T01.1
tctcacaaaaacctcatcaatcacaaccatgggttcaacaggtgaaactcaaacccacatatcaaatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7469 - DNA, 357 bp, Artificial
  MsCOMT deletion introduced by TALEN pair MsCOMT_T01.1
tctcacaaaaacctcatcaatcacaaccatgggttcaacaggtgaaactcaaacccacacatcagacgaataagctaacctctccgccctgcaatcaacaagaccatcaattcttcccatgattttaaaatcagcactttaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaaccagatggaaaagttcagagactttatggtttggctactgttgctaa

SEQ ID NO: 7470 - DNA, 357 bp, Artificial
  MsCOMT deletion introduced by TALEN pair MsCOMT_T01.1
tctcacaaaaacctcatcaatcacaaccatgggttcaacaggtgaaactcaaacccaaatatcagataaagaagcaaacctattcgccatgcaactagtaaaagcatcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7471 - DNA, 360 bp, Artificial
  MsCOMT deletion introduced by TALEN pair MsCOMT_T01.1
tctcacaaaaacctcatcaatcacaaccatgggttcaacaggtgaaactcaaaccacccacatatcagattaagaagcaaacctcttcgccatgcaattagcaagtgcttcagttcttcccatgattttaaaatcagctcttgaacttgatctcttagaaatcattgctaaagctggacctggtgctcaaatttcatctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 7472 - DNA, 360 bp, Artificial
  MsCOMT deletion introduced by TALEN pair MsCOMT_T01.1
tctcacaaaaacctcatcaatcacaaccatgggttcaacaggtgaaactcaaaccacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgtttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7473 - DNA, 360 bp, Artificial
  MsCOMT deletion introduced by TALEN pair MsCOMT_T01.1
tctcacaaaaacctcatcaatcacaaccatgggttcaacaggtgaaactcaaaccacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7474 - DNA, 360 bp, Artificial
  MsCOMT deletion introduced by TALEN pair MsCOMT_T01.1
tctcacaaaaacctcatcaatcacaaccatgggttcaacaggtgaaactcaaaccacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7475 - DNA, 360 bp, Artificial
  MsCOMT deletion introduced by TALEN pair MsCOMT_T01.1
tctcacaaaaacctcatcaatcacaaccatgggttcaacaggtgaaactcaaaccacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7476 - DNA, 360 bp, Artificial
  MsCOMT deletion introduced by TALEN pair MsCOMT_T01.1
tctcacaaaaacctcatcaatcacaaccatgggttcaacaggtgaaactcaaaccacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7477 - DNA, 360 bp, Artificial
  MsCOMT deletion introduced by TALEN pair MsCOMT_T01.1
tctcacaaaaacctcatcaatcacaaccatgggttcaacaggtgaaactcaaaccacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7478 - DNA, 360 bp, Artificial
  MsCOMT deletion introduced by TALEN pair MsCOMT_T01.1
tctcacaaaaacctcatcaatcacaaccatgggttcaacaggtgaaactcaaaccacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 7479 - DNA, 360 bp, Artificial
  MsCOMT deletion introduced by TALEN pair MsCOMT_T01.1
tctcacaaaaacctcatcaatcacaaccatgggttcaacaggtgaaactcaaaccacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 7480 - DNA, 360 bp, Artificial
  MsCOMT deletion introduced by TALEN pair MsCOMT_T01.1
tctcacaaaaacctcatcaatcacaaccatgggttcaacaggtgaaactcaaaccacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatattctcacttgttctgttcgtactcaacaagatggaaagattcagagactttatggtttggctactgttgctaa

SEQ ID NO: 7481 - DNA, 360 bp, Artificial
  MsCOMT deletion introduced by TALEN pair MsCOMT_T01.1
tctcacaaaaacctcatcaatcacaaccatgggttcaacaggtgaaactcaaaccacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 7482 - DNA, 360 bp, Artificial
  MsCOMT deletion introduced by TALEN pair MsCOMT_T01.1
tctcacaaaaacctcatcaatcacaaccatgggttcaacaggtgaaactcaaaccacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7483 - DNA, 360 bp, Artificial
  MsCOMT deletion introduced by TALEN pair MsCOMT_T01.1
tctcacaaaaacctcatcaatcacaaccatgggttcaacaggtgaaactcaaaccacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 7484 - DNA, 360 bp, Artificial
  MsCOMT deletion introduced by TALEN pair MsCOMT_T01.1
tctcacaaaaacctcatcaatcacaaccatgggttcaacaggtgaaactcaaaccacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7485 - DNA, 360 bp, Artificial
  MsCOMT deletion introduced by TALEN pair MsCOMT_T01.1
tctcacaaaaacctcatcaatcacaaccatgggttcaacaggtgaaactcaaaccacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7486 - DNA, 360 bp, Artificial
  MsCOMT deletion introduced by TALEN pair MsCOMT_T01.1
tctcacaaaaacctcatcaatcacaaccatgggttcaacaggtgaaactcaaaccacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7487 - DNA, 360 bp, Artificial
  MsCOMT deletion introduced by TALEN pair MsCOMT_T01.1
tctcacaaaaacctcatcaatcacaaccatgggttcaacaggtgaaactcaaaccacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7488 - DNA, 360 bp, Artificial
  MsCOMT deletion introduced by TALEN pair MsCOMT_T01.1
tctcacaaaaacctcatcaatcacaaccatgggttcaacaggtgaaactcaaaccacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7489 - DNA, 360 bp, Artificial
  MsCOMT deletion introduced by TALEN pair MsCOMT_T01.1
tctcacaaaaacctcatcaatcacaaccatgggttcaacaggtgaaactcaaaccacccacatatcagatgaagaagcaaacctcttcgccatgcaactagcaagtgcttcggttcttcccatgattttaaaatcagctcttgaacttgatctcttagaaatcattgctaaagctggacctggtgctcaaatttcacctattgaaattgcttctcggctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7490 - DNA, 360 bp, Artificial
  MsCOMT deletion introduced by TALEN pair MsCOMT_T01.1
tctcacaaaaacctcatcaatcacaaccatgggttcaacaggtgaaactcaaaccacccacatatcagatgaagaagcaaacctcttcgccatgcaactagcaagtgcttcagttcttcccctgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 7491 - DNA, 360 bp, Artificial
  MsCOMT deletion introduced by TALEN pair MsCOMT_T01.1
tctcacaaaaacctcatcaatcacaaccatgggttcaacaggtgaaactcaaaccacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 7492 - DNA, 360 bp, Artificial
  MsCOMT deletion introduced by TALEN pair MsCOMT_T01.1
tctcacaaaaacctcatcaatcacaaccatgggttcaacaggtgaaactcaaaccacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7493 - DNA, 360 bp, Artificial
  MsCOMT deletion introduced by TALEN pair MsCOMT_T01.1
tctcacaaaaacctcatcaatcacaaccatgggttcaacaggtgaaactcaaaccacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7494 - DNA, 360 bp, Artificial
  MsCOMT deletion introduced by TALEN pair MsCOMT_T01.1
tctcacaaaaacctcatcaatcacaaccatgggttcaacaggtgaaactcaaaccacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7495 - DNA, 360 bp, Artificial
  MsCOMT deletion introduced by TALEN pair MsCOMT_T01.1
tctcacaaaaacctcatcaatcacaaccatgggttcaacaggtgaaactcaaaccacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7496 - DNA, 360 bp, Artificial
  MsCOMT deletion introduced by TALEN pair MsCOMT_T01.1
tctcacaaaaacctcatcaatcacaaccatgggttcaacaggtgaaactcaaaccacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7497 - DNA, 360 bp, Artificial
  MsCOMT deletion introduced by TALEN pair MsCOMT_T01.1
tctcacaaaaacctcatcaatcacaaccatgggttcaacaggtgaaactcaaaccacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 7498 - DNA, 360 bp, Artificial
  MsCOMT deletion introduced by TALEN pair MsCOMT_T01.1
tctcacaaaaacctcatcaatcacaaccatgggttcaacaggtgaaactcaaaccacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7499 - DNA, 360 bp, Artificial
  MsCOMT deletion introduced by TALEN pair MsCOMT_T01.1
tctcacaaaaacctcatcaatcacaaccatgggttcaacaggtgaaactcaaaccacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7500 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagattaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 7501 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccttgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7502 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaattagctagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7503 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7504 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7505 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 7506 - DNA, 362 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactggttgctaa

SEQ ID NO: 7507 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7508 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgatgctaa

SEQ ID NO: 7509 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7510 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7511 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7512 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7513 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaattagcaagtgcttcagttcttcccatgattttgaaatcagctcttgaacttgatctcttagaaatcattgctaaagctggacctggtactcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7514 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaattagcaagtgcttcagttcttcccatgattttgaaatcagctcttgaacttgatctcttagaaatcactgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7515 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 7516 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 7517 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 7518 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7519 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7520 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7521 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagtttgtactcaacaagatggaaagattcagagactttatggtttggctactgttgctaa

SEQ ID NO: 7522 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagctcgtactcaacaagatggaaaggttcagagactttatggtttggctactgttgctaa

SEQ ID NO: 7523 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7524 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7525 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 7526 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7527 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaattagcaagtgcttcagttcttcccatgattttaaaatcagctcttgaacttgatctcttagaaatcattgctaaagctggacctggtactcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7528 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaattagcaagtgcttcagttcttcccatgattttaaaatcagctcttgaacttgatctcttagaaatcactgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7529 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaattagcaagtgcttcagttcttcccatgattttaaaatcagctcttgaacttgatctctcagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7530 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaattagcaagtgcttcagttcatcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7531 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaactagcaagtgcttcggttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7532 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaactagcaagtgcttcagttcttcccatgattttgaaatcagctcttgaacttgatctcttagaaatcattgctacagctggacctggtgctcaaatttcacctattgaaattgcttctcagctcccaacaactaaccctgatgcaccagttatgttggaccgaatgttgcgtctctgggcttgttacaatatcctcacttgttcagttcgtactcaacaagatggaaaggttcagagactttatggtttggctactgttgctaa

SEQ ID NO: 7533 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatgtaaagattcagagactttatggtttggctactgttgctaa

SEQ ID NO: 7534 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 7535 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7536 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7537 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7538 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7539 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 7540 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctag

SEQ ID NO: 7541 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7542 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7543 - DNA, 360 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttctaa

SEQ ID NO: 7544 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7545 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcaaagactttatggtttggctactgttgctaa

SEQ ID NO: 7546 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagaggctttatggtttggctactgttgctaa

SEQ ID NO: 7547 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgataa

SEQ ID NO: 7548 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatagcctcacttgttcagttcgtactcaacaagatggaaaggttcagagactttatggtttggctactgttgctaa

SEQ ID NO: 7549 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 7550 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatgtcctcacttgttcagttcgtactcaacaagatggaaaggttcagagactttatggtttggctactgttgctaa

SEQ ID NO: 7551 - DNA, 360 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 7552 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 7553 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccccgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7554 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaactagcaagtgcttcagttcttcccatgattttgaaatcagctcttgaacttgatctcttagaaatcattactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7555 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7556 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7557 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7558 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7559 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaactagcaagtgcttcagtccttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7560 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaagcaaacctcttcgccatgcaactaacaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 7561 - DNA, 361 bp, Artificial
  MsCOMT deletion introduced by TALEN pair MsCOMT_T01.1
tctcacaaaaacctcatcaatcacaaccatgggttcaacaggtgaaactcaaaccaacccacatatcagatgaagaaacaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7562 - DNA, 357 bp, Artificial
  MsCOMT deletion introduced by TALEN pair MsCOMT_T01.1
tctcacaaaaacctcatcaatcacaaccatgggttcaacaggtgaaactcaaaccaacatatcagatgaataagcaaacctcttcgccctgcaattaacaagtccatcagttcttcccatgattttaaaatcagctcttgaacttgatctcttagaaatcattgctaaagctggacatggtgctcaaatttcacctattgaaagtgcttctcagctcccaacaactaaccctgatgcaccagttatgttggaccgaatgttgcgtctcttggcttgttacaatagccgcacttgttcagttcgtactcaacaagatggaaagattcagagactttatggtttggctactgttgctaa

SEQ ID NO: 7563 - DNA, 353 bp, Artificial
  MsCOMT deletion introduced by TALEN pair MsCOMT_T01.1
tctcacaaaaacctcatcaatcacaaccatgggttcaacaggtgaaactcaaacatatcagattaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7564 - DNA, 353 bp, Artificial
  MsCOMT deletion introduced by TALEN pair MsCOMT_T01.1
tctcacaaaaacctcatcaatcacaaccatgggttcaacaggtgaaactcaaacatatcagattaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7565 - DNA, 353 bp, Artificial
  MsCOMT deletion introduced by TALEN pair MsCOMT_T01.1
tctcacaaaaacctcatcaatcacaaccatgggttcaacaggtgaaactcaaacatatcagatgaagaagcaaacctcttcgccatgccattagcaagtgcttcagttcttcccatgattttaaaatcagctcttgaacttgatctcttagaaatcattgctaaagctggacctggtactcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7566 - DNA, 353 bp, Artificial
  MsCOMT deletion introduced by TALEN pair MsCOMT_T01.1
tctcacaaaaacctcatcaatcacaaccatgggttcaacaggtgaaactcaaacatatcagatgaagaagcaaacctcttcgccatgcaattagcaattgcttcagttcttcccatgattttgaaatcagctcttgaacttgatctcttagaaatcattgctaaagctggacctggtgctcaaatttcacctcttgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7567 - DNA, 353 bp, Artificial
  MsCOMT deletion introduced by TALEN pair MsCOMT_T01.1
tctcacaaaaacctcatcaatcacaaccatgggttcaacaggtgaaactcaaacatatcagatgaagaagcaaacctcttcgccatgcaattagcaattgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7568 - DNA, 353 bp, Artificial
  MsCOMT deletion introduced by TALEN pair MsCOMT_T01.1
tctcacaaaaacctcatcaatcacaaccatgggttcaacaggtgaaactcaaacatatcagatgaagaagcaaacctcttcgccatgcaattagcaagtgcttcagttcttcccatgattttgaaatcagctcttgaacttgatctcttagaaatcattgctaaagctggacctggtgctcaaatttcgcctattgaaattgcttctcaactaccaacaactaaccctgatgcaccagtcatgttggaccgaatgttgcgtctcttggcttgttacaatatcctcacttgttctgttcgtactcaacaagatggaaaggttcagagacttaatggtttggctactgttgctaa

SEQ ID NO: 7569 - DNA, 353 bp, Artificial
  MsCOMT deletion introduced by TALEN pair MsCOMT_T01.1
tctcacaaaaacctcatcaatcacaaccatgggttcaacaggtgaaactcaaacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7570 - DNA, 353 bp, Artificial
  MsCOMT deletion introduced by TALEN pair MsCOMT_T01.1
tctcacaaaaacctcatcaatcacaaccatgggttcaacaggtgaaactcaaacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 7571 - DNA, 353 bp, Artificial
  MsCOMT deletion introduced by TALEN pair MsCOMT_T01.1
tctcacaaaaacctcatcaatcacaaccatgggttcaacaggtgaaactcaaacatatcagatgaagaagcaaacctcttcgccatgcaattagcaagtgcttcagttcttcccatgattttaaaatcagctcttgaacttggtctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7572 - DNA, 353 bp, Artificial
  MsCOMT deletion introduced by TALEN pair MsCOMT_T01.1
tctcacaaaaacctcatcaatcacaaccatgggttcaacaggtgaaactcaaacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7573 - DNA, 352 bp, Artificial
  MsCOMT deletion introduced by TALEN pair MsCOMT_T01.1
tctcacaaaaacctcatcaatcacaaccatgggttcaacaggtgaaactcaaacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttcttagctcccaacaactaaccctgatgcaccagttatgttggaccgaatgttgcgtctcttggcttgttacaatatcctcacttgttcagttcgtactcaacaagatggaaagattcagagactttatggtttggcactgttgctaa

SEQ ID NO: 7574 - DNA, 353 bp, Artificial
  MsCOMT deletion introduced by TALEN pair MsCOMT_T01.1
tctcacaaaaacctcatcaatcacaaccatgggttcaacaggtgaaactcaaacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 7575 - DNA, 353 bp, Artificial
  MsCOMT deletion introduced by TALEN pair MsCOMT_T01.1
tctcacaaaaacctcatcaatcacaaccatgggttcaacaggtgaaactcaaacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7576 - DNA, 353 bp, Artificial
  MsCOMT deletion introduced by TALEN pair MsCOMT_T01.1
tctcacaaaaacctcatcaatcacaaccatgggttcaacaggtgaaactcaaacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7577 - DNA, 353 bp, Artificial
  MsCOMT deletion introduced by TALEN pair MsCOMT_T01.1
tctcacaaaaacctcatcaatcacaaccatgggttcaacaggtgaaactcaaacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7578 - DNA, 353 bp, Artificial
  MsCOMT deletion introduced by TALEN pair MsCOMT_T01.1
tctcacaaaaacctcatcaatcacaaccatgggttcaacaggtgaaactcaaacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttgacttgttacaatatcctcacttgttcagttcgtactcaacaagatggaaagattcagagactttatggtttggctactgttgctaa

SEQ ID NO: 7579 - DNA, 353 bp, Artificial
  MsCOMT deletion introduced by TALEN pair MsCOMT_T01.1
tctcacaaaaacctcatcaatcacaaccatgggttcaacaggtgaaactcaaacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7580 - DNA, 353 bp, Artificial
  MsCOMT deletion introduced by TALEN pair MsCOMT_T01.1
tctcacaaaaacctcatcaatcacaaccatgggttcaacaggtgaaactcaaacatatcagatgaagaagcaaacctcttcgccatgcaattagcaagtgcttcagttcttcccatgattttaaaatcagctcttgaacttgatctcttagaaatcattgctaaagctggacctggtgctcaaattgcacctattgaaattgcttctcacctcccaacaactaaccctgatgcaccagttatgttggaccgaatgttgcgtctcttggcttgttacaatatcctcacttgttcagttcgtactcaacaagatggaaagattcagagactttatggtttggctactgttgcgaa

SEQ ID NO: 7581 - DNA, 353 bp, Artificial
  MsCOMT deletion introduced by TALEN pair MsCOMT_T01.1
tctcacaaaaacctcatcaatcacaaccatgggttcaacaggtgaaactcaaacatatcagatgaagaagcaaacctcttcgccatgcaactagcaattgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7582 - DNA, 353 bp, Artificial
  MsCOMT deletion introduced by TALEN pair MsCOMT_T01.1
tctcacaaaaacctcatcaatcacaaccatgggttcaacaggtgaaactcaaacatatcagatgaagaagcaaacctcttcgccatgcaactagcaattgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 7583 - DNA, 353 bp, Artificial
  MsCOMT deletion introduced by TALEN pair MsCOMT_T01.1
tctcacaaaaacctcatcaatcacaaccatgggttcaacaggtgaaactcaaacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7584 - DNA, 353 bp, Artificial
  MsCOMT deletion introduced by TALEN pair MsCOMT_T01.1
tctcacaaaaacctcatcaatcacaaccatgggttcaacaggtgaaactcaaacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7585 - DNA, 353 bp, Artificial
  MsCOMT deletion introduced by TALEN pair MsCOMT_T01.1
tctcacaaaaacctcatcaatcacaaccatgggttcaacaggtgaaactcaaacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7586 - DNA, 353 bp, Artificial
  MsCOMT deletion introduced by TALEN pair MsCOMT_T01.1
tctcacaaaaacctcatcaatcacaaccatgggttcaacaggtgaaactcaaacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7587 - DNA, 353 bp, Artificial
  MsCOMT deletion introduced by TALEN pair MsCOMT_T01.1
tctcacaaaaacctcatcaatcacaaccatgggttcaacaggtgaaactcaaacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7588 - DNA, 353 bp, Artificial
  MsCOMT deletion introduced by TALEN pair MsCOMT_T01.1
tctcacaaaaacctcatcaatcacaaccatgggttcaacaggtgaaactcaaacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7589 - DNA, 353 bp, Artificial
  MsCOMT deletion introduced by TALEN pair MsCOMT_T01.1
tctcacaaaaacctcatcaatcacaaccatgggttcaacaggtgaaactcaaacatatcagatgaagaagcaaacctcttcgccatgcaactagcaagtgcttcagttctgcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatgcaaaggttcagagcctttatggtttggctactgttgctaa

SEQ ID NO: 7590 - DNA, 359 bp, Artificial
  MsCOMT deletion introduced by TALEN pair MsCOMT_T01.1
tctcacaaaaacctcatcaatcacaaccatgggttcaacaggtgaaactcaaacacccacatatcagatgaagaagcaaacctcttcgccatgcaattagcaagtgcttcagttcttcctatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7591 - DNA, 359 bp, Artificial
  MsCOMT deletion introduced by TALEN pair MsCOMT_T01.1
tctcacaaaaacctcatcaatcacaaccatgggttcaacaggtgaaactcaaacacccacatatcagatgaagaagcaaacctcttcgccatgcaattagcaagtgcttcagttcttcccatgattttgaaatcaggtcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7592 - DNA, 359 bp, Artificial
  MsCOMT deletion introduced by TALEN pair MsCOMT_T01.1
tctcacaaaaacctcatcaatcacaaccatgggttcaacaggtgaaactcaaacacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7593 - DNA, 359 bp, Artificial
  MsCOMT deletion introduced by TALEN pair MsCOMT_T01.1
tctcacaaaaacctcatcaatcacaaccatgggttcaacaggtgaaactcaaacacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7594 - DNA, 359 bp, Artificial
  MsCOMT deletion introduced by TALEN pair MsCOMT_T01.1
tctcacaaaaacctcatcaatcacaaccatgggttcaacaggtgaaactcaaacacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgccaa

SEQ ID NO: 7595 - DNA, 359 bp, Artificial
  MsCOMT deletion introduced by TALEN pair MsCOMT_T01.1
tctcacaaaaacctcatcaatcacaaccatgggttcaacaggtgaaactcaaacacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7596 - DNA, 359 bp, Artificial
  MsCOMT deletion introduced by TALEN pair MsCOMT_T01.1
tctcacaaaaacctcatcaatcacaaccatgggttcaacaggtgaaactcaaacacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7597 - DNA, 359 bp, Artificial
  MsCOMT deletion introduced by TALEN pair MsCOMT_T01.1
tctcacaaaaacctcatcaatcacaaccatgggttcaacaggtgaaactcaaacacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7598 - DNA, 359 bp, Artificial
  MsCOMT deletion introduced by TALEN pair MsCOMT_T01.1
tctcacaaaaacctcatcaatcacaaccatgggttcaacaggtgaaactcaaacacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 7599 - DNA, 359 bp, Artificial
  MsCOMT deletion introduced by TALEN pair MsCOMT_T01.1
tctcacaaaaacctcatcaatcacaaccatgggttcaacaggtgaaactcaaacacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7600 - DNA, 359 bp, Artificial
  MsCOMT deletion introduced by TALEN pair MsCOMT_T01.1
tctcacaaaaacctcatcaatcacaaccatgggttcaacaggtgaaactcaaacacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7601 - DNA, 359 bp, Artificial
  MsCOMT deletion introduced by TALEN pair MsCOMT_T01.1
tctcacaaaaacctcatcaatcacaaccatgggttcaacaggtgaaactcaaacacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7602 - DNA, 359 bp, Artificial
  MsCOMT deletion introduced by TALEN pair MsCOMT_T01.1
tctcacaaaaacctcatcaatcacaaccatgggttcaacaggtgaaactcaaacacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgtttcaatatcctcacttgttcagttcgtactcaacaagatggaaaagttcagagactttatggtttggctactgttgctaa

SEQ ID NO: 7603 - DNA, 359 bp, Artificial
  MsCOMT deletion introduced by TALEN pair MsCOMT_T01.1
tctcacaaaaacctcatcaatcacaaccatgggttcaacaggtgaaactcaaacacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaaccagatggaaaggttcagagactttatggtttggctactgttgctaa

SEQ ID NO: 7604 - DNA, 359 bp, Artificial
  MsCOMT deletion introduced by TALEN pair MsCOMT_T01.1
tctcacaaaaacctcatcaatcacaaccatgggttcaacaggtgaaactcaaacacccacatatcagatgaagaagcaaacctcttcgccatgcaattagcaagtgcttcagttcttcccatgattttaaaatcagctcttgaacttgatctcttagaaatcaatgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7605 - DNA, 359 bp, Artificial
  MsCOMT deletion introduced by TALEN pair MsCOMT_T01.1
tctcacaaaaacctcatcaatcacaaccatgggttcaacaggtgaaactcaaacacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 7606 - DNA, 359 bp, Artificial
  MsCOMT deletion introduced by TALEN pair MsCOMT_T01.1
tctcacaaaaacctcatcaatcacaaccatgggttcaacaggtgaaactcaaacacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 7607 - DNA, 359 bp, Artificial
  MsCOMT deletion introduced by TALEN pair MsCOMT_T01.1
tctcacaaaaacctcatcaatcacaaccatgggttcaacaggtgaaactcaaacacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7608 - DNA, 359 bp, Artificial
  MsCOMT deletion introduced by TALEN pair MsCOMT_T01.1
tctcacaaaaacctcatcaatcacaaccatgggttcaacaggtgaaactcaaacacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7609 - DNA, 359 bp, Artificial
  MsCOMT deletion introduced by TALEN pair MsCOMT_T01.1
tctcacaaaaacctcatcaatcacaaccatgggttcaacaggtgaaactcaaacacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaataagatggaaaggttcagagactttatggtttggctactgttgctaa

SEQ ID NO: 7610 - DNA, 359 bp, Artificial
  MsCOMT deletion introduced by TALEN pair MsCOMT_T01.1
tctcacaaaaacctcatcaatcacaaccatgggttcaacaggtgaaactcaaacacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggtttgttacaatatcctcacttgttcagttcgtactcaacaagatggaaaggttcagagactttatggtttggctactgttgctaa

SEQ ID NO: 7611 - DNA, 359 bp, Artificial
  MsCOMT deletion introduced by TALEN pair MsCOMT_T01.1
tctcacaaaaacctcatcaatcacaaccatgggttcaacaggtgaaactcaaacacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcatctcttggcttgttacaatatcctcacttgttcagttcgtactcaacaagatggaatggttcagagactttatggtttggctactgttgctaa

SEQ ID NO: 7612 - DNA, 359 bp, Artificial
  MsCOMT deletion introduced by TALEN pair MsCOMT_T01.1
tctcacaaaaacctcatcaatcacaaccatgggttcaacaggtgaaactcaaacacccacatatcagatgaagaagcaaacctcttcgccatgcaactagcaagtgcttcagttcttcccatgattttgaaatcagctcttgaacttgatctcttagaaatcattgctaaagctggacctggtgctcaaacttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7613 - DNA, 359 bp, Artificial
  MsCOMT deletion introduced by TALEN pair MsCOMT_T01.1
tctcacaaaaacctcatcaatcacaaccatgggttcaacaggtgaaactcaaacacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7614 - DNA, 359 bp, Artificial
  MsCOMT deletion introduced by TALEN pair MsCOMT_T01.1
tctcacaaaaacctcatcaatcacaaccatgggttcaacaggtgaaactcaaacacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactggtgctaa

SEQ ID NO: 7615 - DNA, 359 bp, Artificial
  MsCOMT deletion introduced by TALEN pair MsCOMT_T01.1
tctcacaaaaacctcatcaatcacaaccatgggttcaacaggtgaaactcaaacacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7616 - DNA, 358 bp, Artificial
  MsCOMT deletion introduced by TALEN pair MsCOMT_T01.1
tctcacaaaaacctcatcaatcacaaccatgggttcaacaggtgaaactcaaacacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgtgcagttcgtactcaacaagatggaaaggttcagagacttatggtttggctactgttgctaa

SEQ ID NO: 7617 - DNA, 359 bp, Artificial
  MsCOMT deletion introduced by TALEN pair MsCOMT_T01.1
tctcacaaaaacctcatcaatcacaaccatgggttcaacaggtgaaactcaaacacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7618 - DNA, 359 bp, Artificial
  MsCOMT deletion introduced by TALEN pair MsCOMT_T01.1
tctcacaaaaacctcatcaatcacaaccatgggttcaacaggtgaaactcaaacacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7619 - DNA, 359 bp, Artificial
  MsCOMT deletion introduced by TALEN pair MsCOMT_T01.1
tctcacaaaaacctcatcaatcacaaccatgggttcaacaggtgaaactcaaacacccacatatcagatgaagaagcaaacctcttcaccatgcaattagcaagtgcttcagttcttcccatgattctaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7620 - DNA, 355 bp, Artificial
  MsCOMT deletion introduced by TALEN pair MsCOMT_T01.1
tctcacaaaaacctcatcaatcacaaccatgggttcaacaggtgaaactcaaacacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7621 - DNA, 355 bp, Artificial
  MsCOMT deletion introduced by TALEN pair MsCOMT_T01.1
tctcacaaaaacctcatcaatcacaaccatgggttcaacaggtgaaactcaaacacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7622 - DNA, 355 bp, Artificial
  MsCOMT deletion introduced by TALEN pair MsCOMT_T01.1
tctcacaaaaacctcatcaatcacaaccatgggttcaacaggtgaaactcaaacacatatcagatgaagaagcaaacctcttcgccatgcaattagcaagtgcttcagttcttcccatgattttaaaatcatctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 7623 - DNA, 355 bp, Artificial
  MsCOMT deletion introduced by TALEN pair MsCOMT_T01.1
tctcacaaaaacctcatcaatcacaaccatgggttcaacaggtgaaactcaaacacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7624 - DNA, 355 bp, Artificial
  MsCOMT deletion introduced by TALEN pair MsCOMT_T01.1
tctcacaaaaacctcatcaatcacaaccatgggttcaacaggtgaaactcaaacacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7625 - DNA, 355 bp, Artificial
  MsCOMT deletion introduced by TALEN pair MsCOMT_T01.1
tctcacaaaaacctcatcaatcacaaccatgggttcaacaggtgaaactcaaacacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatagtttggctactgttgctaa

SEQ ID NO: 7626 - DNA, 355 bp, Artificial
  MsCOMT deletion introduced by TALEN pair MsCOMT_T01.1
tctcacaaaaacctcatcaatcacaaccatgggttcaacaggtgaaactcaaacacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtctggctactgttgctaa

SEQ ID NO: 7627 - DNA, 354 bp, Artificial
  MsCOMT deletion introduced by TALEN pair MsCOMT_T01.1
tctcacaaaaacctcatcaatcacaaccatgggttcaacaggtgaaactcaaacacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggttggctactgttgctaa

SEQ ID NO: 7628 - DNA, 355 bp, Artificial
  MsCOMT deletion introduced by TALEN pair MsCOMT_T01.1
tctcacaaaaacctcatcaatcacaaccatgggttcaacaggtgaaactcaaacacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7629 - DNA, 356 bp, Artificial
  MsCOMT deletion introduced by TALEN pair MsCOMT_T01.1
tctcacaaaaacctcatcaatcacaaccatgggttcaacaggtgaaactcaaacacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggcctactgttgctaa

SEQ ID NO: 7630 - DNA, 355 bp, Artificial
  MsCOMT deletion introduced by TALEN pair MsCOMT_T01.1
tctcacaaaaacctcatcaatcacaaccatgggttcaacaggtgaaactcaaacacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7631 - DNA, 355 bp, Artificial
  MsCOMT deletion introduced by TALEN pair MsCOMT_T01.1
tctcacaaaaacctcatcaatcacaaccatgggttcaacaggtgaaactcaaacacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7632 - DNA, 355 bp, Artificial
  MsCOMT deletion introduced by TALEN pair MsCOMT_T01.1
tctcacaaaaacctcatcaatcacaaccatgggttcaacaggtgaaactcaaacacatatcagatgaagaagcaaacctcttcgccatgcaactagcaagtgctttagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7633 - DNA, 355 bp, Artificial
  MsCOMT deletion introduced by TALEN pair MsCOMT_T01.1
tctcacaaaaacctcatcaatcacaaccatgggttcaacaggtgaaactcaaacacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 7634 - DNA, 355 bp, Artificial
  MsCOMT deletion introduced by TALEN pair MsCOMT_T01.1
tctcacaaaaacctcatcaatcacaaccatgggttcaacaggtgaaactcaaacacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgatcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7635 - DNA, 355 bp, Artificial
  MsCOMT deletion introduced by TALEN pair MsCOMT_T01.1
tctcacaaaaacctcatcaatcacaaccatgggttcaacaggtgaaactcaaacacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgtgtctcttggcttgttacaatatcctcacttgttcagttcgtactcaacaagatggaaaggttcagagactttatggtttggctactgttgctaa

SEQ ID NO: 7636 - DNA, 355 bp, Artificial
  MsCOMT deletion introduced by TALEN pair MsCOMT_T01.1
tctcacaaaaacctcatcaatcacaaccatgggttcaacaggtgaaactcaaacacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7637 - DNA, 355 bp, Artificial
  MsCOMT deletion introduced by TALEN pair MsCOMT_T01.1
tctcacaaaaacctcatcaatcacaaccatgggttcaacaggtgaaactcaaacacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7638 - DNA, 355 bp, Artificial
  MsCOMT deletion introduced by TALEN pair MsCOMT_T01.1
tctcacaaaaacctcatcaatcacaaccatgggttcaacaggtgaaactcaaacacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7639 - DNA, 355 bp, Artificial
  MsCOMT deletion introduced by TALEN pair MsCOMT_T01.1
tctcacaaaaacctcatcaatcacaaccatgggttcaacaggtgaaactcaaacacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7640 - DNA, 355 bp, Artificial
  MsCOMT deletion introduced by TALEN pair MsCOMT_T01.1
tctcacaaaaacctcatcaatcacaaccatgggttcaacaggtgaaactcaaacacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggataggttcagagactttatggtttggctactgttgctaa

SEQ ID NO: 7641 - DNA, 355 bp, Artificial
  MsCOMT deletion introduced by TALEN pair MsCOMT_T01.1
tctcacaaaaacctcatcaatcacaaccatgggttcaacaggtgaaactcaaacacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7642 - DNA, 355 bp, Artificial
  MsCOMT deletion introduced by TALEN pair MsCOMT_T01.1
tctcacaaaaacctcatcaatcacaaccatgggttcaacaggtgaaactcaaacacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7643 - DNA, 355 bp, Artificial
  MsCOMT deletion introduced by TALEN pair MsCOMT_T01.1
tctcacaaaaacctcatcaatcacaaccatgggttcaacaggtgaaactcaaacacatatcacatgaagaagcaaaccacttcgccatgcaactagcaagtacttcagttcttcccatgattttgaaatcagctcttaaacttgatctcttataaatcattgctaaatctggacctagtgctcaaatttcgcctattgaaattgcttcgcagctcccaccaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7644 - DNA, 357 bp, Artificial
  MsCOMT deletion introduced by TALEN pair MsCOMT_T01.1
tctcacaaaaacctcatcaatcacaaccatgggttcaacaggtgaaactcaaacacacatatcagatgaagaagcaaacctcttcgacatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7645 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatctcagatgaagaagcaaacctcttcgccatgcaattagcaagtgcttcagttcttcccatgattttgaaatcagctcttgaacttgatctcttagaaatcattgctaaagctggacctggtactcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7646 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatctcagatgaagaagcaaacatcttcgccatgcaattagcaagtgcttcagttcttcccatgattttaaaatcagctcttgaacttgatctcttagaaatcattgctaaagctggaactggtgctcaaatttcacctattgaaattgcttctcagctaccaacaactaaccctgatgcaccagttatgttggaccgaatgttgcgtctcttggcttgttacaatttcctcacttgttcagttcgtactcaacaagatggaaaggttcagagactttatggtttggctactgttgctaa

SEQ ID NO: 7647 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcatattaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggacctaatgttgcgtctcttggcttgttacaatatcctcacttgttcagttcgtactcaacaagatggaaagattcagagactttatggtttggctactgttgctaa

SEQ ID NO: 7648 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcatatgaagaagcaaacctcttcgccatgcaattagcaagtgcttcagttcttcccctgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7649 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcatatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7650 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagattaagaagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7651 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagattaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7652 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagattaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7653 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagattaagaagcaaacctcttcgccatgcaactagcaagtgcttcagttcttcccctgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7654 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagattaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7655 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagatgcaaacctcttcgccatgcaattagcaagagcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7656 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgtaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7657 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccctgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7658 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccctgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7659 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccattattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7660 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 7661 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 7662 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7663 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7664 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 7665 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttgtcttgttacaatatcctcacttgttctgttcgtcctcaacaagatggaaaggttcagagtctttatggtttggctactgttgctaa

SEQ ID NO: 7666 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7667 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7668 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7669 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagctcgtactcaacaagatggaaaggttcagagactttatggtttggctactgttgctaa

SEQ ID NO: 7670 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 7671 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagctatgttggaccgaatgttgcgtctcttggcttgttacaatatcctcacttgttctgttcgtactcaacaagatggaaaggttcagagactttatggtttggctactgttgctaa

SEQ ID NO: 7672 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttataatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7673 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttaaaatcagttcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7674 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttaaaatcagctcttgaacttgatctcttagcaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7675 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttaaaatcagctcttgaacttgatctcttagcaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 7676 - DNA, 359 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttaaaatcagctcttgaacttgatctcttagaaatcattgctaagctggacctggtgctcaaatttcacctattgaaattgcttctccgctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7677 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttaaaatcagctcttgaacttgatctcttagaaatcattgctaacgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7678 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7679 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7680 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7681 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 7682 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 7683 - DNA, 359 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggcactgttgctaa

SEQ ID NO: 7684 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 7685 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7686 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7687 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 7688 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccagcaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7689 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgattcaccagttatgttggaccgaatgttgcgtctcttggcttgttacaatatcctcacttgttcagttcgtactcaacaagatggaaaggttcagagactttatggtttggctactgttgctaa

SEQ ID NO: 7690 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7691 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7692 - DNA, 359 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtaaacaacaagatggaaagattcagagactttatggtttggctacgttgctaa

SEQ ID NO: 7693 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7694 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 7695 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggatcggagactttatggtttggctactgttgctaa

SEQ ID NO: 7696 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtatcttggcttgttacaatatcctcacttgttcagttcgtactcaacaagatggaaaggttcagagactttatggtttggctacagttgctaa

SEQ ID NO: 7697 - DNA, 361 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatgtaaaggttcagagactttatgggttggctactgttgctaac

SEQ ID NO: 7698 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccaaatgttgcgtctcttggcttgttacaatatcctcccttgttcagttcgtactcaacaagatggaaagattcagagactttatggtttggctactgttgctaa

SEQ ID NO: 7699 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgctgctaa

SEQ ID NO: 7700 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgtgacaatatcctcacttgttcagttcgtactcaacaagatggaaagattcagagactttatggtttggctactgttgctaa

SEQ ID NO: 7701 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcgacaagatggaaagattcagagactttatggtttggctactgttgctaa

SEQ ID NO: 7702 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggcgactgttgctaa

SEQ ID NO: 7703 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatttggcgtctcttggcttgttacaatatcctcacttgttcagttcgtactcaacaagatgcaaagattcagagactttatggtttcgctcctgtggcaaa

SEQ ID NO: 7704 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactcttgctaa

SEQ ID NO: 7705 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatatggcgtctcttggcttgttacaatatcctcacttgttcagttcgtactcaacaagatcgaaagattcagagtctttatggtttggctactgttgctaa

SEQ ID NO: 7706 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacgagatggaaaggttcagagactttatggtttggctactgttgctaa

SEQ ID NO: 7707 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 7708 - DNA, 358 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactggctaa

SEQ ID NO: 7709 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7710 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7711 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7712 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7713 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 7714 - DNA, 359 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctatgttgctaa

SEQ ID NO: 7715 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttattcagttcgtactcaacaagatggaaaggttcagagactttatggtttggctactgttgctaa

SEQ ID NO: 7716 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 7717 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttaaaatcagctcttgaacttgatctcttagaaatcattgctaaagctggacctggtcctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7718 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttaaaatcagctcttgaacttgatctctcagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagcctttatggtttggctactgttgctaa

SEQ ID NO: 7719 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagtgcttcagttcttcccatgattttaaaatcagctcttgaactcgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7720 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagagcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 7721 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattagcaagagcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7722 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaattaccaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7723 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaataagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7724 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaactagcaagtgcttcagttcttcccatgattttgaaatcagctcttgaacttgatctcttagcaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7725 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaactagcaagtgcttcagttcttcccatgattttgaaatcagctcttgaacttgatctcttagaaatcattgctaacgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagcctttatggtttggctactgttgctaa

SEQ ID NO: 7726 - DNA, 359 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 7727 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 7728 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttttcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7729 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcggctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7730 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7731 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 7732 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7733 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7734 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 7735 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7736 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtgctcaacaagatggaaaggttcagagactttatggtttggctactgttgctaa

SEQ ID NO: 7737 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgtgtctcttggcttgttacaatatcctcacttgttcagttcgtactcaacaagatggaaaggttcagagactttatggtttggctactgttgctaa

SEQ ID NO: 7738 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7739 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7740 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7741 - DNA, 359 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggttggctactgttgctaa

SEQ ID NO: 7742 - DNA, 359 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggcactgttgctaa

SEQ ID NO: 7743 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgtcgcgtctcttggcttgttacaatatcctcacttgttcagttcgtactcaacaagatggaaaagttcagagactttatggtttggctactgttgctaa

SEQ ID NO: 7744 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcggagactttatggtttggctactgttgctaa

SEQ ID NO: 7745 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 7746 - DNA, 359 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttgctactgttgctaa

SEQ ID NO: 7747 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcatctcttggcttgttacaatatcctcacttgttcagttcgtactcaacaagatggaaaggttcagagactttatggtttggctactgttgctaa

SEQ ID NO: 7748 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagcctttatggtttggctactgttgctaa

SEQ ID NO: 7749 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaatgttcagagactttatggtttggctactggtgctaa

SEQ ID NO: 7750 - DNA, 359 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttgctactgttgctaa

SEQ ID NO: 7751 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 7752 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattccttctcagctaccaacaactaaccctgatgcaccagttatgtttgaccgaatttttcgtctcttgtcttgttacaatatcctcactttttctgttcgtactcaacaagatggaaattttcagagactttatggtttggctactgttgctaa

SEQ ID NO: 7753 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaactagcaagtgcttcagttcttcccatgattttgaaatcagctcttgaacttgatctcttagaaatcattgctaaagctggacctggtactcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7754 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaactagcaagtgcttcagttcttcccatgattttgaaatcagctcttgaactcgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 7755 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7756 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7757 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7758 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7759 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 7760 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7761 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7762 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaactagcaagtgcttcagttcttcccatgattttaaaatcagctcttgaactcgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7763 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaactagcaagtgcttcagttcttcccatgattatgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7764 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaactagcaagtgcttcagttcttcccatgactttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7765 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccatgcaactagcaagtgcttcagttctccccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7766 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcttcgccaagcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7767 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacctcatcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7768 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaaccccttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7769 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacatatcagatgaagaagcaaacatcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccaaatgttgcgtctcttggcttgttacaatatcctcacttgttcagttcgtactcaacaagacggaaaggttcagagactttatggtttggctactgttgctaa

SEQ ID NO: 7770 - DNA, 360 bp, Artificial
  MsCOMT deletion introduced by TALEN pair MsCOMT_T01.1
tctcacaaaaacctcatcaatcacaaccatgggttcaacaggtgaaactcaaacaacccacataccagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7771 - DNA, 357 bp, Artificial
  MsCOMT deletion introduced by TALEN pair MsCOMT_T01.1
tctcacaaaaacctcatcaatcacaaccatgggttcaacaggtgaaactcaaacaaaaatatcagatgaagaagcaaaactattcgccctgcaattaacaagagcatcagttctttccatgattttaaaatcagctattgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7772 - DNA, 357 bp, Artificial
  MsCOMT deletion introduced by TALEN pair MsCOMT_T01.1
tctcacaaaaacctcatcaatcacaaccatgggttcaacaggtgaaactcaaacaaaaataaccgataaataagcagacctagtcaacatgcaactaacaaaagcatcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7773 - DNA, 429 bp, Artificial
  MsCOMT deletion introduced by TALEN pair MsCOMT_T01.1
tctcacaaaaacctcatcaatcacaaccatgggttcaacaggtgaaactcaaaagaactgctgataggatcccccaatccctttttcactgcatccatcgcaggacgcccgccgaggcaggccaacccacatatcagatgaagaagcaaacctcttcgccatgcaactagccagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7774 - DNA, 429 bp, Artificial
  MsCOMT deletion introduced by TALEN pair MsCOMT_T01.1
tctcacaaaaacctcatcaatcacaaccatgggttcaacaggtgaaactcaaaagaactgctgataggatcccccaatccctttttcactgcatccagcgcaggacgcccgccgaggcaggccaacccacatatcagatgaagaagcaaacctcttcgccatgcaactagccagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7775 - DNA, 429 bp, Artificial
  MsCOMT deletion introduced by TALEN pair MsCOMT_T01.1
tctcacaaaaacctcatcaatcacaaccatgggttcaacaggtgaaactcaaaagaacggctgatagtatcccccaatccctttttcactgcatccaacgcaggacgcccgccgaggcaggccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7776 - DNA, 429 bp, Artificial
  MsCOMT deletion introduced by TALEN pair MsCOMT_T01.1
tctcacaaaaacctcatcaatcacaaccatgggttcaacaggtgaaactcaaaagaacggctgataggatcccccaatccctttttcactgcatccagcgcaggatgcccgccgaggcaggccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7777 - DNA, 429 bp, Artificial
  MsCOMT deletion introduced by TALEN pair MsCOMT_T01.1
tctcacaaaaacctcatcaatcacaaccatgggttcaacaggtgaaactcaaaagaacggctgataggatcccccaatccctttttcactgcatccagcgcaggacgcccgccgaggcaggccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7778 - DNA, 358 bp, Artificial
  MsCOMT deletion introduced by TALEN pair MsCOMT_T01.1
tctcacaaaaacctcatcaatcacaaccatgggttcaacaggtgaaactcaaaacgcacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 7779 - DNA, 358 bp, Artificial
  MsCOMT deletion introduced by TALEN pair MsCOMT_T01.1
tctcacaaaaacctcatcaatcacaaccatgggttcaacaggtgaaactcaaaacctacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7780 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacctatcagctgaagaagcaaacctcttcaccattcaattagcaagttcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7781 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcggatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7782 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagttgaagaagcaaacctcttcgccatgtaactaccaagtgcttcagttcttcccatgattttaaaatcagctcttgaacttgatctcttagaaatcattgctaaagctggacctggtgctcaactttcacctattgaaattgcttctcagctcccaccaactaaccctgatgcaccagttatgttgaaccgaatgttgcgtctcttggcttgttacaatatcctcacttgttcagttcgtactcaacaagatggaaaggttcagagactgtatggtttgcctactgttgctaa

SEQ ID NO: 7783 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagctgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcgtctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7784 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagctgaagaagcaaacctcttcgccatgcaactatcaagtgcttcagttcttcccatgattttaaaatcagctcttgaacttgatctcttagaaatcattgctaaagctggacctagtgctcaaatttcacctattgaaattgcttctcagctcccaacaactaaccctgatgcaccagttatgttggaccgaatgttgcgtctcttggcttgttacaatttcctcacttgttcagttcgtactcaacaagatggaaaggttcagagactttatggtttggcgactgttgctaa

SEQ ID NO: 7785 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagctgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7786 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagattaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7787 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaggaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7788 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaatcctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7789 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgtcatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7790 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgtcatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7791 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcggcatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7792 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccctgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7793 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccctgcaactatcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7794 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccctgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7795 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccctgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7796 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccattcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7797 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccattcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7798 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccattcaattagcaagtgcttcagttcttcccatgattttaaaatcagctcttgaacttgatctcttagaaatcattgctaaagctggacctggtgctcaaattccacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7799 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccattcaattagcaagtgcttcagttcttcccatgattttaaaatcagctcttgaacttgatctcttagaaatcattactaaatctggacctggtgctcaaatttcacctattgaaattgcttctcagctaccaacaactaaccctgatgcaccagttatgttggaacgaatgttgcgtctcttggcttgttacaatatcctcacttgttcagttcgtactcaacaagatggaaagattcagagactttatggtttggctactgttgctaa

SEQ ID NO: 7800 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7801 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 7802 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccattcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7803 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccattcaactagcaagtgcctcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7804 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgtaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 7805 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatggaattagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7806 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattatcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 7807 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattatcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 7808 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattatcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7809 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattatcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7810 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattatcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctctttgcttgttacaatatcctctcttgttcagttcgtactcaacaagatggaaagattcagagcctttatggtttggctactgttgctaa

SEQ ID NO: 7811 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcccttgttcagttcgtactcaacaagatggaaaagttcagagactttatggtttggctactgttgctaa

SEQ ID NO: 7812 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 7813 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 7814 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 7815 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7816 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaggattcagagactttatggtttggctactgttgctaa

SEQ ID NO: 7817 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7818 - DNA, 354 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttg

SEQ ID NO: 7819 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 7820 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7821 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7822 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggattgttacaatatcctcacttgttcagttcgtactcaacaagatggaaagattcagagactttatggtttggctactgttgctaa

SEQ ID NO: 7823 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 7824 - DNA, 357 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactttgctaa

SEQ ID NO: 7825 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattatcaagtgcttcagttcttcccatgattttaaaatcagctcttgaacttgatctcttagaaatcattgctaaagctggacctggtactcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7826 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattatcaagtgcttcagttcttcccatgattttaaaatcagctcttgaacgtgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 7827 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaggtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7828 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttctcatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7829 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttgaaatcagctcttgaacttgatctcttagacatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7830 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7831 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 7832 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7833 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcggctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7834 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7835 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 7836 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 7837 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7838 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcctactcaacaagatggaaagattcagagactttatggtttggctactgttgctaa

SEQ ID NO: 7839 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7840 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7841 - DNA, 357 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgcta

SEQ ID NO: 7842 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 7843 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7844 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 7845 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacatgatggaaaagttcagagactttatggtttggctactgttgctaa

SEQ ID NO: 7846 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7847 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7848 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggttttgctactgttgctaa

SEQ ID NO: 7849 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggcgactgttgctaa

SEQ ID NO: 7850 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 7851 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 7852 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttgaaatcagctcttgaacttgatctcttagaaatcattgctaaagctggacccggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7853 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagagatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7854 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctgggcctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7855 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgtttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 7856 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7857 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattctgagactttatggtttggctactgttgctaa

SEQ ID NO: 7858 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7859 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7860 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 7861 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 7862 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagaccttatggtttggctactgttgctaa

SEQ ID NO: 7863 - DNA, 357 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgcta

SEQ ID NO: 7864 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 7865 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaatgttcagagactttatggtttggctactgttgctaa

SEQ ID NO: 7866 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaagttcagagactttatggtttggctactgttgctaa

SEQ ID NO: 7867 - DNA, 356 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctacttgctaa

SEQ ID NO: 7868 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7869 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7870 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatccccacttgttcagttcgtactcaacaagatggaaagattcagagactttatggtttggctactgttgctaa

SEQ ID NO: 7871 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccatttatgttggaccgaatgttgcgtctcttggcttgttacaatatcctcacttgttcagttcgtactcaacaagatggaaaggttcagagactttatggtttggctactgttgctaa

SEQ ID NO: 7872 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7873 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7874 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaatttgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7875 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaatttcttctcagctcccaacaactaaccctgatgcaccagttatgttgtaccgaatgttgcgtctcttggcttgttacaatatcctcacttgttcatttcttactcaacaagattgaaaatttcagagactttatggtttggctactgttgctaa

SEQ ID NO: 7876 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 7877 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 7878 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7879 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7880 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7881 - DNA, 357 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatgtttggctactgttgctaa

SEQ ID NO: 7882 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttaccatatcctcacttgttcagttcgtactcaacaagatggaaagattcagagactttatggtttggctactgttgctaa

SEQ ID NO: 7883 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 7884 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagtccgttctcaacaagatggaaagattcagagactttatggtttggctactgttgctaa

SEQ ID NO: 7885 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccaaatgttgcgtctcttggcttgttacaatatcctcacttgttcagttcgtactcaacaagatggaaagattcagagactttatggtttggctactgttgctaa

SEQ ID NO: 7886 - DNA, 357 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttgctactgttgctaa

SEQ ID NO: 7887 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 7888 - DNA, 357 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctctgttgctaa

SEQ ID NO: 7889 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgattcttgcgtctcttggcttgttacaatatcctcacttgttcagttcgtactcaacaagatggaaagattcagagactttatggtttggctactgttgctaa

SEQ ID NO: 7890 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctctcttgttcagttcgtactcaacaagatggaaaggttcagagactttatggtttggctactgttgctaa

SEQ ID NO: 7891 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctgctgttgctaa

SEQ ID NO: 7892 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcccttgttcagttcgtactcaacaagatggaaaagttcagagactttatggtttggctactgttgctaa

SEQ ID NO: 7893 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacgtgttcagttcgtactcaacaagatggaaagattcagagactttatggtttggctactgttgctaa

SEQ ID NO: 7894 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactggtgctaa

SEQ ID NO: 7895 - DNA, 357 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctatgttgctaa

SEQ ID NO: 7896 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 7897 - DNA, 357 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgtaa

SEQ ID NO: 7898 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcatttcgtactcaacaagatggaaaggttcagagaccttatggtttggctactgttgctaa

SEQ ID NO: 7899 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttgtcttgttacaatatcctcacttgttcagttcgtactcaacaagatggaaaggttcagagactttatggtttggctactgttgctaa

SEQ ID NO: 7900 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaacgaatgttgcgtctcttggcttgttacaatatcctcacttgttcagttcgtactcaacaagatggaaagattcagagactttatggtttggctactgttgctaa

SEQ ID NO: 7901 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 7902 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 7903 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 7904 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccatgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7905 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttgtaccgaatgttgcgtctcttggcttgttacaatatcctcacttgttcagttcgtactcaacaagatggaaaggttcagagactttatggtttggctactgttgctaa

SEQ ID NO: 7906 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttgggccgaatgttgcgtcacttggcttgttacaatatcctcacttgttcagttcgtactcaacaagatggaaaggttcagagactttatggtttggctactgttgctaa

SEQ ID NO: 7907 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7908 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 7909 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7910 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7911 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactctacaagatggaaaggttcagagactttatggtttggctactgttgctaa

SEQ ID NO: 7912 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaaaatcctcacttgttcagttcgtactcaacaagatggaaaagttcagagactttatggtttggctactgttgctaa

SEQ ID NO: 7913 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggcgactgttgctaa

SEQ ID NO: 7914 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggatactgttgctaa

SEQ ID NO: 7915 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatgatttggctactgttgctaa

SEQ ID NO: 7916 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaagggttcagagactttatggtttggctactgttgctaa

SEQ ID NO: 7917 - DNA, 357 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgtgcagttcgtactcaacaagatggaaaggttcagagactttatggtttggctactgttctaa

SEQ ID NO: 7918 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 7919 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaattccacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7920 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaattacacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7921 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaacttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7922 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgatcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 7923 - DNA, 357 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctagtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgcta

SEQ ID NO: 7924 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagcgggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7925 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgcgaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7926 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7927 - DNA, 357 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctctgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7928 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcaggtcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7929 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcttcaggtcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7930 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgctccagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttagctactgttgctaa

SEQ ID NO: 7931 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgctacagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7932 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgcctcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7933 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattagcaagtgattcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7934 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattaacaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactgtatggtttggctactgttgctaa

SEQ ID NO: 7935 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattaacaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7936 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaattaacaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7937 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactatcaagtgcttcagttcttcccatgattttgcaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7938 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactatcaagtgcttcagttcttcccatgattttgcaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7939 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactatcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgtcctgttcgtactcaacaagatggaaaggttcagagactttatggtttggctactgttgctaa

SEQ ID NO: 7940 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactatcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 7941 - DNA, 359 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactatcaagtgcttcagttcttcccatgattttgaaatcagctcttgaacttgatctcttagaaatcattgctaaagctggacctggtgctcaaatttcacctattgaaattgcttctcagctcccaacaactaacccttatgcaccagttatgttggaccgaatgttgcgtctcttggcttgttacaatatcctcacttgttcagttcgtactcaacaagatggaaaggttcagagactttatgggttggcctactgttgctaa

SEQ ID NO: 7942 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactatcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7943 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactatcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagcctttatggtttggctactgttgctaa

SEQ ID NO: 7944 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactatcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7945 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactatcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 7946 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactatcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcccttgttcagttcgtactcaaccagatggaaaggttcagagactttattgtttgcctactgttgctaa

SEQ ID NO: 7947 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactatcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttgaaccgaatgttgcgtctcttggcttgttacaatatcctcacttgttcagtttgtactcaataagatggaaagattcagagactttatggtttggctactgttgctaa

SEQ ID NO: 7948 - DNA, 357 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactatcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 7949 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactatcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7950 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactatcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7951 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactatcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggccactgttgctaa

SEQ ID NO: 7952 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactatcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7953 - DNA, 357 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactatcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttctaa

SEQ ID NO: 7954 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactatcaagtgcttcagttcttcccatgattttgaaatcagctcgtgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7955 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactatcaagtgcttcagttcttcccatgattttaaaatcagctcttgaacttgatctcttagaaatcattgctaaagctggacctggtgctcaaatttcacctattgaaattgcttctcagctcccaacaactaaccctgatgtaccagttatgttggaccgaatgttgcgtctcttggcttgttacaatatcctcacttgttcagttcgtactcaacaagatggaaaagttcagagactttatggtttggctactgttgctaa

SEQ ID NO: 7956 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactatcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7957 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactatcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7958 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactatcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7959 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactatcaagtgcttcagttcttcccatgattttaaaatcagctcttgaacttgatctcttagaaatcatcgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7960 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactatcaagtgcttcagttcttcacatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7961 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagctagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7962 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcgagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7963 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttctcatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7964 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcctatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7965 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgagcttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7966 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaagtcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7967 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacgtggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7968 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggaccttgtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7969 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7970 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 7971 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 7972 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 7973 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 7974 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatgggaaggttcagagactttatggtttggctactgttgctaa

SEQ ID NO: 7975 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 7976 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7977 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcggagactttatggtttggctactgttgctaa

SEQ ID NO: 7978 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7979 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7980 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgtttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7981 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 7982 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 7983 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtgctcaacaagatggaaaggttcagagactttatggtttggctactgttgctaa

SEQ ID NO: 7984 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttgggacgaattgttgcgcccctgggcttgtaccaaaatcctccttgttcagttcgtactcaacaagatggaaaggttcagagactttatggtttggctactgttgctaa

SEQ ID NO: 7985 - DNA, 356 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagatgcagagactttatggtttggctactgttgaa

SEQ ID NO: 7986 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 7987 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7988 - DNA, 359 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgtttgctaa

SEQ ID NO: 7989 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctctcttgttcagttcgtactcgacaagatggaaaggttcagagactttatggtttggctactgttgctaa

SEQ ID NO: 7990 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaagttcagagactttatggtttggctactgttgctaa

SEQ ID NO: 7991 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7992 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttgtggtttggctactgttgctaa

SEQ ID NO: 7993 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 7994 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 7995 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccccgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7996 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 7997 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaatcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 7998 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggtccgaatggtgcgtctcttggctgggtacaatatcctcacttgttcagttcgtactcaacaagatggaaaggttcagagactttatggttgggcgaatgttgagaa

SEQ ID NO: 7999 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggatcgaatgttgcgtctcttggcttgttacaatatcctcacttgttcagttcgtactcaacaagatggaaaggttcagagactttatggtttggctactgttgctaa

SEQ ID NO: 8000 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggagcgaatgttgcgtctcttggattgttacaatatcctcacttgttcagttcgtactcaacaagatggaaaggttcagagactttatggtttggctacagttgctaa

SEQ ID NO: 8001 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8002 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8003 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8004 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttaagagactttatggtttggctactgttgctaa

SEQ ID NO: 8005 - DNA, 357 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgcta

SEQ ID NO: 8006 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactctatggtttggctactgttgctaa

SEQ ID NO: 8007 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtgctcaacaagatggaaaggttcagagactttatggtttggctactgttgctaa

SEQ ID NO: 8008 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatgggaaggttcagagactttatggtttggctactgttgctaa

SEQ ID NO: 8009 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttgcaatatcctcacttgttcagttcgtactcaacaagatggaaagattcagagactttatggtttggctactgttgctaa

SEQ ID NO: 8010 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 8011 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatcgtttggctactgttgctaa

SEQ ID NO: 8012 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttagggtttggctactgttgctaa

SEQ ID NO: 8013 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttccgttcgtactcaacaagatggaaagattcagagcctttatggtttggctactgttgctaa

SEQ ID NO: 8014 - DNA, 357 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgcaa

SEQ ID NO: 8015 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggtccagagactttatggtttggctactgttgctaa

SEQ ID NO: 8016 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggttgggctactgttgctaa

SEQ ID NO: 8017 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttacggtttggctactgttgctaa

SEQ ID NO: 8018 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagcctttatggtttggctactgttgctaa

SEQ ID NO: 8019 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcggttcgtactcaacaagatggaaaggttcagagactttatggtttggctactgttgctaa

SEQ ID NO: 8020 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgtccagttcgtactcaacaagatggaaaagttcagagactttatggtttggctactgttgctaa

SEQ ID NO: 8021 - DNA, 357 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 8022 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcctggcttgttacaatatcctcacttgttcagttcgtactcaacaagatggaaaggttcagagactttatggtttggctactgttgctaa

SEQ ID NO: 8023 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaacgaatgttgcgtctcttggcttgttacaatatcctcacttgttcagttcgtactcaacaagatggaaaagttcagagactttatggtttggctactgttgctaa

SEQ ID NO: 8024 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 8025 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 8026 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgctcctcagctaccaacaactaaccctgatgcaccagttatgttggaccgaatgttgcgtctcttggcttgttacaatatcctcacttgttcagttcgtactcaaccagatggaaaggttcagagactttatggtttggctactgttgctaa

SEQ ID NO: 8027 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcctctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8028 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctatcgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8029 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaacttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8030 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgatcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8031 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtactcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8032 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtactcaaatttcacctattgaaattgcttctcagctaccaacaactaaccctgatgcaccagttatgttggaccgaatgtttcgtctcttggcttgttacaatatcctcacttgttcatttcgtactcaacaagatggaaaggttcagagactttatggtttggctactgttgctaa

SEQ ID NO: 8033 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctgatgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactggtgctaa

SEQ ID NO: 8034 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctagtgctcaaatttcacctattgaaattgcttctcagctaccaacaactaaccctgatacatcagttatgttggacagaatgttgcgtctcttggcttgttacaatatcctcacttgttcagttcgtactcaacaagatggaaaggttcagagactttatggtttggctactgttgctaa

SEQ ID NO: 8035 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcatcgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8036 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttgaaaccagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8037 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcagctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8038 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgtttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 8039 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaagttcagagactttatggtttggctactgttgctaa

SEQ ID NO: 8040 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 8041 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8042 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8043 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 8044 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8045 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctattgttgctaa

SEQ ID NO: 8046 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 8047 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagaggctttatggtttggctactgttgctaa

SEQ ID NO: 8048 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8049 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8050 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttgcaatatcctcacttgttcagttcgtactcaacaagatggaaagattcagagactttatggtttggctactgttgctaa

SEQ ID NO: 8051 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 8052 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 8053 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaacccggatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8054 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8055 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8056 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8057 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 8058 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctctgggcttgttacaatatcctcacttgttcagttcgtactcaacaagatggaaaggttcagagactttatggtttggctactgttgctaa

SEQ ID NO: 8059 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtattcaacaagatggaaaagttcagagactttatggtttggctactgttgctaa

SEQ ID NO: 8060 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 8061 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 8062 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcaactattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8063 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcaactattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8064 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattgtaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8065 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgcttcagttcttcccatgattctgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8066 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgctccagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8067 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactagcaagtgctacagttcttcccatgattttgaaatcagctcttgaacttgatctcttagaaatcattgctaaagctggacctggtgctcaaatttcacctattgaaattgcttcacagctcccaacaactaaccctgatgcaccagttatgttggaccgaatgttgcgtctcttggcttgttacaatatcctcacttgttcagttcgtactcaacaagatggaaatattcagtgactttatcgtttggctactgttgctaa

SEQ ID NO: 8068 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatgcaactaacaagtgcttcagttcttcccatgattttgaaatcagctcttgaacttcatctcttagaaatcattgctaaagctggacctggtgcataagtttcacctattgaaattgcttctcagctcccaacaactcaccctgatgtaccagttatgttgtaccgaattttgcatctcttggcttgttacaatattctcaattgttcagttcgtactcaacaacatggaaaggttcagagagtttacggtttggctactgttgctaa

SEQ ID NO: 8069 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccatacaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8070 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccaggcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8071 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccaggcaactagcaagtgcttcagtgcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtgtggctactgttgctaa

SEQ ID NO: 8072 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcgccacgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8073 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctcttcaccatgcaactagcaaattcgtcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8074 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagatgaagaagcaaacctattcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8075 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagataaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8076 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacatatcagaggaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 8077 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacataccagcttaagaggcaaacctctacaccatgcaatcagcaagttcgtcagtgcttcccatgattttaaaatcagctcttgaacttgatctcttagaaatcattgctaaagctggacctggtgctcaaatttcacctattcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 8078 - DNA, 358 bp, Artificial
  MsCOMT deletion introduced by TALEN pair MsCOMT_T01.1
tctcacaaaaacctcatcaatcacaaccatgggttcaacaggtgaaactcaaaacccacataccagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8079 - DNA, 358 bp, Artificial
  MsCOMT deletion introduced by TALEN pair MsCOMT_T01.1
tctcacaaaaacctcatcaatcacaaccatgggttcaacaggtgaaactcaaaacacacatatcagatgaagaagcaaacctcttcgccattcaactatcaagtgcttcagttcttcccatgattttaaaatcagctcttgaacttgatctcttagaaatcattactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8080 - DNA, 358 bp, Artificial
  MsCOMT deletion introduced by TALEN pair MsCOMT_T01.1
tctcacaaaaacctcatcaatcacaaccatgggttcaacaggtgaaactcaaaacacacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttattttggaccgaatgttgcgtctcttggcttgttacaatatcctcacttgttcagttcgtactcaacaagatggaaagattcagagactttatggtttggctactgttgctaa

SEQ ID NO: 8081 - DNA, 352 bp, Artificial
  MsCOMT deletion introduced by TALEN pair MsCOMT_T01.1
tctcacaaaaacctcatcaatcacaaccatgggttcaacaggtgaaactcaaaaatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgcta

SEQ ID NO: 8082 - DNA, 352 bp, Artificial
  MsCOMT deletion introduced by TALEN pair MsCOMT_T01.1
tctcacaaaaacctcatcaatcacaaccatgggttcaacaggtgaaactcaaaaatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgcta

SEQ ID NO: 8083 - DNA, 353 bp, Artificial
  MsCOMT deletion introduced by TALEN pair MsCOMT_T01.1
tctcacaaaaacctcatcaatcacaaccatgggttcaacaggtgaaactcaaaaatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaggatggaaaggttcagagactttatggtttggctactgttgctaa

SEQ ID NO: 8084 - DNA, 353 bp, Artificial
  MsCOMT deletion introduced by TALEN pair MsCOMT_T01.1
tctcacaaaaacctcatcaatcacaaccatgggttcaacaggtgaaactcaaaaatatcagatgaagaagcaaacctcttcgccatgcaactagcaattgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8085 - DNA, 353 bp, Artificial
  MsCOMT deletion introduced by TALEN pair MsCOMT_T01.1
tctcacaaaaacctcatcaatcacaaccatgggttcaacaggtgaaactcaaaaatatcagatgaagaagcaaacctcttcgccatgcaactagcaattgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8086 - DNA, 353 bp, Artificial
  MsCOMT deletion introduced by TALEN pair MsCOMT_T01.1
tctcacaaaaacctcatcaatcacaaccatgggttcaacaggtgaaactcaaaaatatcagatgaagaagcaaacctcttcgccatgcaactagcaattgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8087 - DNA, 353 bp, Artificial
  MsCOMT deletion introduced by TALEN pair MsCOMT_T01.1
tctcacaaaaacctcatcaatcacaaccatgggttcaacaggtgaaactcaaaaatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8088 - DNA, 353 bp, Artificial
  MsCOMT deletion introduced by TALEN pair MsCOMT_T01.1
tctcacaaaaacctcatcaatcacaaccatgggttcaacaggtgaaactcaaaaatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8089 - DNA, 353 bp, Artificial
  MsCOMT deletion introduced by TALEN pair MsCOMT_T01.1
tctcacaaaaacctcatcaatcacaaccatgggttcaacaggtgaaactcaaaaatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8090 - DNA, 353 bp, Artificial
  MsCOMT deletion introduced by TALEN pair MsCOMT_T01.1
tctcacaaaaacctcatcaatcacaaccatgggttcaacaggtgaaactcaaaaatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8091 - DNA, 353 bp, Artificial
  MsCOMT deletion introduced by TALEN pair MsCOMT_T01.1
tctcacaaaaacctcatcaatcacaaccatgggttcaacaggtgaaactcaaaaatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatgctttggctactgttgctaa

SEQ ID NO: 8092 - DNA, 353 bp, Artificial
  MsCOMT deletion introduced by TALEN pair MsCOMT_T01.1
tctcacaaaaacctcatcaatcacaaccatgggttcaacaggtgaaactcaaaaatatcagatgaagaagcaaacctcttcgccatgcaactagcaagtgcttcagttcttcccatgattttgaaatcagctcttgaacatgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8093 - DNA, 353 bp, Artificial
  MsCOMT deletion introduced by TALEN pair MsCOMT_T01.1
tctcacaaaaacctcatcaatcacaaccatgggttcaacaggtgaaactcaaaaatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8094 - DNA, 355 bp, Artificial
  MsCOMT deletion introduced by TALEN pair MsCOMT_T01.1
tctcacaaaaacctcatcaatcacaaccatgggttcaacaggtgaaactcaaaaacttatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8095 - DNA, 359 bp, Artificial
  MsCOMT deletion introduced by TALEN pair MsCOMT_T01.1
tctcacaaaaacctcatcaatcacaaccatgggttcaacaggtgaaactcaaaaacctacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 8096 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccccatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8097 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcatatgaagaagcaaacctcttcgccatgcaattatcaatttcttcagttcttcccatgattttaaaatcagctcttgaacttgatctcttagaaatcattgctaaagctgcacctggtgctcaaatttcacctattggaattgcttctcagctcccaacaactaaccctgatgccccagttatgttggaccgaatgttgcgtatcttggcttgttacaatatcctcacttgttcagttcgtactcaagaagatggaaagattcagagactgtatggtttggctaatgttgctaa

SEQ ID NO: 8098 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgtcatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8099 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 8100 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8101 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8102 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgagtgttgcgtctcttggcttgttacaatatcctcacttgttcagttcgtactcaacaagatggaaaggttcagagactttatggtttggctactgttgctaa

SEQ ID NO: 8103 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 8104 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8105 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8106 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaattagcaagtgcttcagttcttcccatgattttaagatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8107 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaattagcaagtgcttcagttcttcccatgattttaaaatcagctcttgaacttgatctcttagaaatcattgctaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8108 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaattagcaagtgcttcagttcttcccatgattttaaaatcagctcttgaacttgatctcttagaaatcattgctaaagctggacctgttgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggatactgttgctaa

SEQ ID NO: 8109 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8110 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 8111 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 8112 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 8113 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8114 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8115 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8116 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8117 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactgtatggtttggctactgttgctaa

SEQ ID NO: 8118 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 8119 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcggctcttggcttgttacaatatcctcacttgttcagttcgtactcaacaagatggaaaggttcagagactttatggtttggctactgttgctaa

SEQ ID NO: 8120 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagttggaaagattcagagactttatggtttggctactgttgctaa

SEQ ID NO: 8121 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgttctcaacaagatggaaaggttcagagactttatggtttggctactgttgctaa

SEQ ID NO: 8122 - DNA, 358 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggtactgttgctaa

SEQ ID NO: 8123 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgagtgttgcgtctcttggctggttacaatatcctcacttgttcagttcgtactcaacaagatggaaagattcagagactttatggtttggctactgttgctaa

SEQ ID NO: 8124 - DNA, 358 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 8125 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgctgcgtctcttggcttgttacaatatcctcacttgttcagttcgtactcaacaagatggaaaggttcagagactttatggtttggctactgttgctaa

SEQ ID NO: 8126 - DNA, 358 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttgctactgttgctaa

SEQ ID NO: 8127 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctga

SEQ ID NO: 8128 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcaattcgtactcaacaagatggaaagattcagagactttatggtttggctactgttgctaa

SEQ ID NO: 8129 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgtaggaccgaatgttgcgtctcttggcttgttacaatatcctcacttgttcagttcgtactcaacaagatggaaaggttcagagactttatggtttggctactgttgctaa

SEQ ID NO: 8130 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 8131 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8132 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8133 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8134 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcatgttacaaaatcctcacttgttcagttcgtactcaacaagatggaaaggttcagagactttatggtttggctactgttgctaa

SEQ ID NO: 8135 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttaacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8136 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaattagcaagtgcttcagttcttcccatgattttaaaatcagctcttgaacttgatctcttaaaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8137 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaattagcaagtgcttcagttcttcccatgattttaaaatcagctcatgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8138 - DNA, 358 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaattagaagtgcctcaggtcttcccaagattttaaaatcagctcttgaacttgatttcttagaaattcttgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 8139 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaattaacaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 8140 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaactagcaagttcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8141 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaactagcaagtgcttcagttcttcccatgatttttaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8142 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaactagcaagtgcttcagttcttcccatgattttgaaatcagctctttaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8143 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaactagcaagtgcttcagttcttcccatgattttgaaatcagctcttgaacttgatctcttagaaatcattgctaaggctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8144 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcatctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8145 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 8146 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 8147 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8148 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8149 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8150 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgttctcaacaagatggaaaggttcagagactttatggtttggctactgttgctaa

SEQ ID NO: 8151 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 8152 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 8153 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8154 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8155 - DNA, 360 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggcctactgttgctaa

SEQ ID NO: 8156 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 8157 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8158 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcggctcttggcttgttacaatatcctcacttgttcagttcgtactcaacaagatggaaaggttcagagactttatggtttggctactgttgctaa

SEQ ID NO: 8159 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcggttcgtactcaacaagatggaaaagttcagagactttatggtttggctactgttgctaa

SEQ ID NO: 8160 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaaccagatggaaaggttcagagcctttatggtttggctactgttgctaa

SEQ ID NO: 8161 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaagggttcagagactttatggtttggctactgttgctaa

SEQ ID NO: 8162 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttggtacaatatcctcacttggtcaggtcgtacccaacaagatggaaaggttcagagactttatggtttggcgactggtgctaa

SEQ ID NO: 8163 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 8164 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgctcctcagctaccaacaactaaccctgatgcaccagttatgttggaccgaatgttgcgtctcttggcttgttacaatatcctcacttgttcagttcgtactcaacaagatggaaaggttcagagactttattgtttggctactgttgctaa

SEQ ID NO: 8165 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaattacacctattgaaattgcttctcagctcccaacaactaaccctgatgcaccagttatgttggaccgaatgttgcgtctcttggcttgtgacaatatcctcacttgttcagttcgtactcaacaagatggaaaggttcagagactttatggtttggctactgttgctaa

SEQ ID NO: 8166 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaactagcaagtgcttcagttcttcccatgattttgaaatcagctcttgaacttgatctcttagaaatcattgctaaagctggacctggtcctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8167 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaactagcaagtgcttcagttcttcccatgattttgaaatcagctcttgaacttgatctcttagaaatcattactaaagctggacctggtgctcaaatttcacctattgaaattgcttctcagctcccaacaactaaccctgatgcaccagttatgttggaccgaatgttgcgtctcttggcttgttacaaaatcctcacttgttcagttcgtactcaacaagatggaaaggttcagagactttatggtttggctactgttgctaa

SEQ ID NO: 8168 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 8169 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8170 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8171 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8172 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 8173 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8174 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 8175 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagtgcgtactcaacaagatggaaagattcagagactttatggtttggctactgttgctaa

SEQ ID NO: 8176 - DNA, 358 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaactagcaagtgcttcagttcttcccatgatttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactgtatggtttggctactgttgctaa

SEQ ID NO: 8177 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaactagcaagtgcttcagttcttcccatgatttcgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8178 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaactagcaagtgcttcagtccttcccatgattttaaaatcagctcttgaacttgatctcttagaaatcattgctaaagctggacctggtgctcaaatttcacctgttcaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 8179 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccatgcaactagcaagtacttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8180 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgccacgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 8181 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcgcaatgcaattagcaagtgcttcagttcttcccatgattttgaaatcagctcttgaacttgatctcttagaaatcattgctaaagctggacctggtgctcaaatttcacctattgaaatttcttctcagctaccaacaactaaccctgatgcaccagttatgttggaccgaatgttgcgtctcttgtcttgttacaatatcctcacttgttcagttcttactcaacaagatggaaaggttcagagactttatggtttggctactattgctaa

SEQ ID NO: 8182 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacatatcagatgaagaagcaaacctcttcaccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8183 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccacacatcagatgaagaagcaaacatctccgccacacaaattgcaagagcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8184 - DNA, 359 bp, Artificial
  MsCOMT deletion introduced by TALEN pair MsCOMT_T01.1
tctcacaaaaacctcatcaatcacaaccatgggttcaacaggtgaaactcaaaaacccaaatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8185 - DNA, 355 bp, Artificial
  MsCOMT deletion introduced by TALEN pair MsCOMT_T01.1
tctcacaaaaacctcatcaatcacaaccatgggttcaacaggtgaaactcaaaaacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8186 - DNA, 355 bp, Artificial
  MsCOMT deletion introduced by TALEN pair MsCOMT_T01.1
tctcacaaaaacctcatcaatcacaaccatgggttcaacaggtgaaactcaaaaacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8187 - DNA, 355 bp, Artificial
  MsCOMT deletion introduced by TALEN pair MsCOMT_T01.1
tctcacaaaaacctcatcaatcacaaccatgggttcaacaggtgaaactcaaaaacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8188 - DNA, 355 bp, Artificial
  MsCOMT deletion introduced by TALEN pair MsCOMT_T01.1
tctcacaaaaacctcatcaatcacaaccatgggttcaacaggtgaaactcaaaaacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaagttcagagactttatggtttggctactgttgctaa

SEQ ID NO: 8189 - DNA, 355 bp, Artificial
  MsCOMT deletion introduced by TALEN pair MsCOMT_T01.1
tctcacaaaaacctcatcaatcacaaccatgggttcaacaggtgaaactcaaaaacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8190 - DNA, 355 bp, Artificial
  MsCOMT deletion introduced by TALEN pair MsCOMT_T01.1
tctcacaaaaacctcatcaatcacaaccatgggttcaacaggtgaaactcaaaaacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8191 - DNA, 355 bp, Artificial
  MsCOMT deletion introduced by TALEN pair MsCOMT_T01.1
tctcacaaaaacctcatcaatcacaaccatgggttcaacaggtgaaactcaaaaacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8192 - DNA, 355 bp, Artificial
  MsCOMT deletion introduced by TALEN pair MsCOMT_T01.1
tctcacaaaaacctcatcaatcacaaccatgggttcaacaggtgaaactcaaaaacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8193 - DNA, 355 bp, Artificial
  MsCOMT deletion introduced by TALEN pair MsCOMT_T01.1
tctcacaaaaacctcatcaatcacaaccatgggttcaacaggtgaaactcaaaaacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8194 - DNA, 355 bp, Artificial
  MsCOMT deletion introduced by TALEN pair MsCOMT_T01.1
tctcacaaaaacctcatcaatcacaaccatgggttcaacaggtgaaactcaaaaacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8195 - DNA, 354 bp, Artificial
  MsCOMT deletion introduced by TALEN pair MsCOMT_T01.1
tctcacaaaaacctcatcaatcacaaccatgggttcaacaggtgaaactcaaaaacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgtgctaa

SEQ ID NO: 8196 - DNA, 355 bp, Artificial
  MsCOMT deletion introduced by TALEN pair MsCOMT_T01.1
tctcacaaaaacctcatcaatcacaaccatgggttcaacaggtgaaactcaaaaacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctga

SEQ ID NO: 8197 - DNA, 355 bp, Artificial
  MsCOMT deletion introduced by TALEN pair MsCOMT_T01.1
tctcacaaaaacctcatcaatcacaaccatgggttcaacaggtgaaactcaaaaacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8198 - DNA, 355 bp, Artificial
  MsCOMT deletion introduced by TALEN pair MsCOMT_T01.1
tctcacaaaaacctcatcaatcacaaccatgggttcaacaggtgaaactcaaaaacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8199 - DNA, 355 bp, Artificial
  MsCOMT deletion introduced by TALEN pair MsCOMT_T01.1
tctcacaaaaacctcatcaatcacaaccatgggttcaacaggtgaaactcaaaaacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagtccgtactcaacaagatggaaaggttcagagactttatggtttggctactgttgctaa

SEQ ID NO: 8200 - DNA, 355 bp, Artificial
  MsCOMT deletion introduced by TALEN pair MsCOMT_T01.1
tctcacaaaaacctcatcaatcacaaccatgggttcaacaggtgaaactcaaaaacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8201 - DNA, 355 bp, Artificial
  MsCOMT deletion introduced by TALEN pair MsCOMT_T01.1
tctcacaaaaacctcatcaatcacaaccatgggttcaacaggtgaaactcaaaaacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8202 - DNA, 355 bp, Artificial
  MsCOMT deletion introduced by TALEN pair MsCOMT_T01.1
tctcacaaaaacctcatcaatcacaaccatgggttcaacaggtgaaactcaaaaacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaagttcagagactttatggtttggctactgttgctaa

SEQ ID NO: 8203 - DNA, 355 bp, Artificial
  MsCOMT deletion introduced by TALEN pair MsCOMT_T01.1
tctcacaaaaacctcatcaatcacaaccatgggttcaacaggtgaaactcaaaaacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatattgcgtctcttggcttgttacaatatcctcacttgttcagttcgtactcaacaagatggaaaggttcagagactttatggtttggctactgttgctaa

SEQ ID NO: 8204 - DNA, 355 bp, Artificial
  MsCOMT deletion introduced by TALEN pair MsCOMT_T01.1
tctcacaaaaacctcatcaatcacaaccatgggttcaacaggtgaaactcaaaaacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8205 - DNA, 355 bp, Artificial
  MsCOMT deletion introduced by TALEN pair MsCOMT_T01.1
tctcacaaaaacctcatcaatcacaaccatgggttcaacaggtgaaactcaaaaacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8206 - DNA, 355 bp, Artificial
  MsCOMT deletion introduced by TALEN pair MsCOMT_T01.1
tctcacaaaaacctcatcaatcacaaccatgggttcaacaggtgaaactcaaaaacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 8207 - DNA, 355 bp, Artificial
  MsCOMT deletion introduced by TALEN pair MsCOMT_T01.1
tctcacaaaaacctcatcaatcacaaccatgggttcaacaggtgaaactcaaaaacatatcagatgaagaagcaaacctcttcgccatgcaactagcaagtgcttcagttctccccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 8208 - DNA, 360 bp, Artificial
  MsCOMT deletion introduced by TALEN pair MsCOMT_T01.1
tctcacaaaaacctcatcaatcacaaccatgggttcaacaggtgaaactcaaaaaacccacatatcatatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8209 - DNA, 360 bp, Artificial
  MsCOMT deletion introduced by TALEN pair MsCOMT_T01.1
tctcacaaaaacctcatcaatcacaaccatgggttcaacaggtgaaactcaaaaaacccacatatcagatgaagaagcaaacctcttcgccatgcgactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 8210 - DNA, 360 bp, Artificial
  MsCOMT deletion introduced by TALEN pair MsCOMT_T01.1
tctcacaaaaacctcatcaatcacaaccatgggttcaacaggtgaaactcaaaaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8211 - DNA, 360 bp, Artificial
  MsCOMT deletion introduced by TALEN pair MsCOMT_T01.1
tctcacaaaaacctcatcaatcacaaccatgggttcaacaggtgaaactcaaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8212 - DNA, 360 bp, Artificial
  MsCOMT deletion introduced by TALEN pair MsCOMT_T01.1
tctcacaaaaacctcatcaatcacaaccatgggttcaacaggtgaaactcaaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaagggttcagagactttatggtttggctactgttgctaa

SEQ ID NO: 8213 - DNA, 360 bp, Artificial
  MsCOMT deletion introduced by TALEN pair MsCOMT_T01.1
tctcacaaaaacctcatcaatcacaaccatgggttcaacaggtgaaactcaaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8214 - DNA, 360 bp, Artificial
  MsCOMT deletion introduced by TALEN pair MsCOMT_T01.1
tctcacaaaaacctcatcaatcacaaccatgggttcaacaggtgaaactcaaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8215 - DNA, 360 bp, Artificial
  MsCOMT deletion introduced by TALEN pair MsCOMT_T01.1
tctcacaaaaacctcatcaatcacaaccatgggttcaacaggtgaaactcaaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacatctaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 8216 - DNA, 360 bp, Artificial
  MsCOMT deletion introduced by TALEN pair MsCOMT_T01.1
tctcacaaaaacctcatcaatcacaaccatgggttcaacaggtgaaactcaaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8217 - DNA, 360 bp, Artificial
  MsCOMT deletion introduced by TALEN pair MsCOMT_T01.1
tctcacaaaaacctcatcaatcacaaccatgggttcaacaggtgaaactcaaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8218 - DNA, 360 bp, Artificial
  MsCOMT deletion introduced by TALEN pair MsCOMT_T01.1
tctcacaaaaacctcatcaatcacaaccatgggttcaacaggtgaaactcaaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8219 - DNA, 360 bp, Artificial
  MsCOMT deletion introduced by TALEN pair MsCOMT_T01.1
tctcacaaaaacctcatcaatcacaaccatgggttcaacaggtgaaactcaaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 8220 - DNA, 360 bp, Artificial
  MsCOMT deletion introduced by TALEN pair MsCOMT_T01.1
tctcacaaaaacctcatcaatcacaaccatgggttcaacaggtgaaactcaaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagacggaaaagttcagagactttatggtttggctactgttgctaa

SEQ ID NO: 8221 - DNA, 360 bp, Artificial
  MsCOMT deletion introduced by TALEN pair MsCOMT_T01.1
tctcacaaaaacctcatcaatcacaaccatgggttcaacaggtgaaactcaaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8222 - DNA, 360 bp, Artificial
  MsCOMT deletion introduced by TALEN pair MsCOMT_T01.1
tctcacaaaaacctcatcaatcacaaccatgggttcaacaggtgaaactcaaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8223 - DNA, 360 bp, Artificial
  MsCOMT deletion introduced by TALEN pair MsCOMT_T01.1
tctcacaaaaacctcatcaatcacaaccatgggttcaacaggtgaaactcaaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8224 - DNA, 360 bp, Artificial
  MsCOMT deletion introduced by TALEN pair MsCOMT_T01.1
tctcacaaaaacctcatcaatcacaaccatgggttcaacaggtgaaactcaaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttgaaccgaatgttgcgtctcttggcttgttacaatatcctcacttgttcagttcgtactcaacaagatggaaaagttcagagactttatggtttggctactgttgctaa

SEQ ID NO: 8225 - DNA, 360 bp, Artificial
  MsCOMT deletion introduced by TALEN pair MsCOMT_T01.1
tctcacaaaaacctcatcaatcacaaccatgggttcaacaggtgaaactcaaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 8226 - DNA, 360 bp, Artificial
  MsCOMT deletion introduced by TALEN pair MsCOMT_T01.1
tctcacaaaaacctcatcaatcacaaccatgggttcaacaggtgaaactcaaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctaagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8227 - DNA, 360 bp, Artificial
  MsCOMT deletion introduced by TALEN pair MsCOMT_T01.1
tctcacaaaaacctcatcaatcacaaccatgggttcaacaggtgaaactcaaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctactgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggccactgttgctaa

SEQ ID NO: 8228 - DNA, 360 bp, Artificial
  MsCOMT deletion introduced by TALEN pair MsCOMT_T01.1
tctcacaaaaacctcatcaatcacaaccatgggttcaacaggtgaaactcaaaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8229 - DNA, 360 bp, Artificial
  MsCOMT deletion introduced by TALEN pair MsCOMT_T01.1
tctcacaaaaacctcatcaatcacaaccatgggttcaacaggtgaaactcaaaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8230 - DNA, 360 bp, Artificial
  MsCOMT deletion introduced by TALEN pair MsCOMT_T01.1
tctcacaaaaacctcatcaatcacaaccatgggttcaacaggtgaaactcaaaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8231 - DNA, 360 bp, Artificial
  MsCOMT deletion introduced by TALEN pair MsCOMT_T01.1
tctcacaaaaacctcatcaatcacaaccatgggttcaacaggtgaaactcaaaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8232 - DNA, 359 bp, Artificial
  MsCOMT deletion introduced by TALEN pair MsCOMT_T01.1
tctcacaaaaacctcatcaatcacaaccatgggttcaacaggtgaaactcaaaaaaccacatatcagatgaagaagcaaacctcttcgccatgcaattagcaagtgcttcatttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgtttcgtcgcttggcttgttacaatatcctcacttgttcagttcttactcaacaagatggaaaggttcagagactttatggtttggctactgttactaa

SEQ ID NO: 8233 - DNA, 346 bp, Artificial
  MsCOMT deletion introduced by TALEN pair MsCOMT_T01.1
tctcacaaaaacctcatcaatcacaaccatgggttcaacaggtgaaactatcagatgaagaagtaaacctcttcgccatgcaactagcaagtgcttcagttcttcccatgattttgaaatcagctcttgaacttgatctcttagaaatcattgctaaagctggacctggtgctcaaatttcacctattgaaattggttctcagctaccaacaactaaccctgatgcaccagttatgtttgaccgaatgttgcgtctctgggcttgttacaatatcctcacttgttcagttcgtactcaacaagatggaaaagttcagagactttatggtttggctactgttgctaa

SEQ ID NO: 8234 - DNA, 345 bp, Artificial
  MsCOMT deletion introduced by TALEN pair MsCOMT_T01.1
tctcacaaaaacctcatcaatcacaaccatgggttcaacaggtgaaactatcagatgaagaagcaaacctcttcgccatgcacttagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggttggctactgttgctaa

SEQ ID NO: 8235 - DNA, 346 bp, Artificial
  MsCOMT deletion introduced by TALEN pair MsCOMT_T01.1
tctcacaaaaacctcatcaatcacaaccatgggttcaacaggtgaaactatcagatgaagaagcaaacctcttcgccatgcacctagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8236 - DNA, 346 bp, Artificial
  MsCOMT deletion introduced by TALEN pair MsCOMT_T01.1
tctcacaaaaacctcatcaatcacaaccatgggttcaacaggtgaaactatcagatgaagaagcaaacctcttcgccatgcacctagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 8237 - DNA, 346 bp, Artificial
  MsCOMT deletion introduced by TALEN pair MsCOMT_T01.1
tctcacaaaaacctcatcaatcacaaccatgggttcaacaggtgaaactatcagatgaagaagcaaacctcttcgccatgcacctagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8238 - DNA, 346 bp, Artificial
  MsCOMT deletion introduced by TALEN pair MsCOMT_T01.1
tctcacaaaaacctcatcaatcacaaccatgggttcaacaggtgaaactatcagatgaagaagcaaacctcttcgccatgcaattagtaagcgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8239 - DNA, 346 bp, Artificial
  MsCOMT deletion introduced by TALEN pair MsCOMT_T01.1
tctcacaaaaacctcatcaatcacaaccatgggttcaacaggtgaaactatcagatgaagaagcaaacctcttcgccatgcaattagccagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8240 - DNA, 346 bp, Artificial
  MsCOMT deletion introduced by TALEN pair MsCOMT_T01.1
tctcacaaaaacctcatcaatcacaaccatgggttcaacaggtgaaactatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8241 - DNA, 346 bp, Artificial
  MsCOMT deletion introduced by TALEN pair MsCOMT_T01.1
tctcacaaaaacctcatcaatcacaaccatgggttcaacaggtgaaactatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8242 - DNA, 346 bp, Artificial
  MsCOMT deletion introduced by TALEN pair MsCOMT_T01.1
tctcacaaaaacctcatcaatcacaaccatgggttcaacaggtgaaactatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8243 - DNA, 346 bp, Artificial
  MsCOMT deletion introduced by TALEN pair MsCOMT_T01.1
tctcacaaaaacctcatcaatcacaaccatgggttcaacaggtgaaactatcagatgaagaagcaaacctcttcgccatgcaactagccagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8244 - DNA, 346 bp, Artificial
  MsCOMT deletion introduced by TALEN pair MsCOMT_T01.1
tctcacaaaaacctcatcaatcacaaccatgggttcaacaggtgaaactatcagatgaagaagcaaacctcttcgccatgcaactagcaagtgcttcagttcttcccatgattttgaaatccgctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8245 - DNA, 346 bp, Artificial
  MsCOMT deletion introduced by TALEN pair MsCOMT_T01.1
tctcacaaaaacctcatcaatcacaaccatgggttcaacaggtgaaactatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8246 - DNA, 346 bp, Artificial
  MsCOMT deletion introduced by TALEN pair MsCOMT_T01.1
tctcacaaaaacctcatcaatcacaaccatgggttcaacaggtgaaactatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8247 - DNA, 346 bp, Artificial
  MsCOMT deletion introduced by TALEN pair MsCOMT_T01.1
tctcacaaaaacctcatcaatcacaaccatgggttcaacaggtgaaactatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8248 - DNA, 346 bp, Artificial
  MsCOMT deletion introduced by TALEN pair MsCOMT_T01.1
tctcacaaaaacctcatcaatcacaaccatgggttcaacaggtgaaactatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8249 - DNA, 346 bp, Artificial
  MsCOMT deletion introduced by TALEN pair MsCOMT_T01.1
tctcacaaaaacctcatcaatcacaaccatgggttcaacaggtgaaactatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8250 - DNA, 346 bp, Artificial
  MsCOMT deletion introduced by TALEN pair MsCOMT_T01.1
tctcacaaaaacctcatcaatcacaaccatgggttcaacaggtgaaactatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgtccagttcgtactcaacaagatggaaaggttcagagactttatggtttggctactgttgctaa

SEQ ID NO: 8251 - DNA, 346 bp, Artificial
  MsCOMT deletion introduced by TALEN pair MsCOMT_T01.1
tctcacaaaaacctcatcaatcacaaccatgggttcaacaggtgaaactatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8252 - DNA, 344 bp, Artificial
  MsCOMT deletion introduced by TALEN pair MsCOMT_T01.1
tctcacaaaaacctcatcaatcacaaccatgggttcaacaggtgaaactatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggtactgttgcaa

SEQ ID NO: 8253 - DNA, 346 bp, Artificial
  MsCOMT deletion introduced by TALEN pair MsCOMT_T01.1
tctcacaaaaacctcatcaatcacaaccatgggttcaacaggtgaaactatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8254 - DNA, 346 bp, Artificial
  MsCOMT deletion introduced by TALEN pair MsCOMT_T01.1
tctcacaaaaacctcatcaatcacaaccatgggttcaacaggtgaaactatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8255 - DNA, 345 bp, Artificial
  MsCOMT deletion introduced by TALEN pair MsCOMT_T01.1
tctcacaaaaacctcatcaatcacaaccatgggttcaacaggtgaaactaaagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaagttcagagactttatggtttggctactgttgctaa

SEQ ID NO: 8256 - DNA, 356 bp, Artificial
  MsCOMT deletion introduced by TALEN pair MsCOMT_T01.1
tctcacaaaaacctcatcaatcacaaccatgggttcaacaggtgaaactaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagcctttatggtttggctactgttgctaa

SEQ ID NO: 8257 - DNA, 361 bp, Artificial
  MsCOMT deletion introduced by TALEN pair MsCOMT_T01.1
tctcacaaaaacctcatcaatcacaaccatgggttcaacaggtgaaactaaaatcaacccacatatctgatgaagaagcaaacctcttcgccatgcaattagcaagtgcttcagttcttcccatgattttaaaatcagctcttgaacttgatctcttagaaatcattgctaaagctgtacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8258 - DNA, 358 bp, Artificial
  MsCOMT deletion introduced by TALEN pair MsCOMT_T01.1
tctcacaaaaacctcatcaatcacaaccatgggttcaacaggtgaaactaaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggcactgttgctaa

SEQ ID NO: 8259 - DNA, 363 bp, Artificial
  MsCOMT deletion introduced by TALEN pair MsCOMT_T01.1
tctcacaaaaacctcatcaatcacaaccatgggttcaacaggtgaaactaaaataccaacccacatatcagatgaagaagcaaacctcttctccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8260 - DNA, 360 bp, Artificial
  MsCOMT deletion introduced by TALEN pair MsCOMT_T01.1
tctcacaaaaacctcatcaatcacaaccatgggttcaacaggtgaaactaaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8261 - DNA, 360 bp, Artificial
  MsCOMT deletion introduced by TALEN pair MsCOMT_T01.1
tctcacaaaaacctcatcaatcacaaccatgggttcaacaggtgaaactaaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8262 - DNA, 364 bp, Artificial
  MsCOMT deletion introduced by TALEN pair MsCOMT_T01.1
tctcacaaaaacctcatcaatcacaaccatgggttcaacaggtgaaactaaaataaccaacccacatatcagatgaagaagccaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8263 - DNA, 364 bp, Artificial
  MsCOMT deletion introduced by TALEN pair MsCOMT_T01.1
tctcacaaaaacctcatcaatcacaaccatgggttcaacaggtgaaactaaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8264 - DNA, 364 bp, Artificial
  MsCOMT deletion introduced by TALEN pair MsCOMT_T01.1
tctcacaaaaacctcatcaatcacaaccatgggttcaacaggtgaaactaaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8265 - DNA, 361 bp, Artificial
  MsCOMT deletion introduced by TALEN pair MsCOMT_T01.1
tctcacaaaaacctcatcaatcacaaccatgggttcaacaggtgaaactaaaataaacccacatatcagatgaagaagcaaacctcttcgccatgcaattagcaagtgcttcagttcttcccatgattttaaaatcagctcttgaacttgatctcttagaaatcattgctaaagctggacctggtgcttaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8266 - DNA, 361 bp, Artificial
  MsCOMT deletion introduced by TALEN pair MsCOMT_T01.1
tctcacaaaaacctcatcaatcacaaccatgggttcaacaggtgaaactaaaataaacccacatatcagatgaagaagcaaacctcttcgccatgcaattagcaagggcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8267 - DNA, 361 bp, Artificial
  MsCOMT deletion introduced by TALEN pair MsCOMT_T01.1
tctcacaaaaacctcatcaatcacaaccatgggttcaacaggtgaaactaaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttgtaccgaatgttgcatctcatggctagtaaaaatagcctcacttgttcagttcgtactcaacaagatggaaaagttaagagactttatggattggctcctggtgctaa

SEQ ID NO: 8268 - DNA, 361 bp, Artificial
  MsCOMT deletion introduced by TALEN pair MsCOMT_T01.1
tctcacaaaaacctcatcaatcacaaccatgggttcaacaggtgaaactaaaataaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8269 - DNA, 362 bp, Artificial
  MsCOMT deletion introduced by TALEN pair MsCOMT_T01.1
tctcacaaaaacctcatcaatcacaaccatgggttcaacaggtgaaactaaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8270 - DNA, 357 bp, Artificial
  MsCOMT deletion introduced by TALEN pair MsCOMT_T01.1
tctcacaaaaacctcatcaatcacaaccatgggttcaacaggtgaaactaaaacccacatatcagattaagaagcaaacctcttcgccatgcaattatcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8271 - DNA, 357 bp, Artificial
  MsCOMT deletion introduced by TALEN pair MsCOMT_T01.1
tctcacaaaaacctcatcaatcacaaccatgggttcaacaggtgaaactaaaacccacatatcagatgaagaagcaaacctcttcgtcatgcaactatcaagtgcttcagttcttcccatgattttgaaatcagctcttgaacttgatctcttagaaatcattgctaaagctggacctggtgctcaagtttcacctattgaaattgcttctcagctaccaacaactaaccctgatgcaccagttatgttggaccgaatgttgcgtctcttggcttgttacaatatcctcacttgttcagttcgtactcaacaagatggaaagtttcacagactttatggtttggctactgtttctaa

SEQ ID NO: 8272 - DNA, 357 bp, Artificial
  MsCOMT deletion introduced by TALEN pair MsCOMT_T01.1
tctcacaaaaacctcatcaatcacaaccatgggttcaacaggtgaaactaaaacccacatatcagatgaagaagcaaacctcttcgccatgcaactaacaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8273 - DNA, 361 bp, Artificial
  MsCOMT deletion introduced by TALEN pair MsCOMT_T01.1
tctcacaaaaacctcatcaatcacaaccatgggttcaacaggtgaaactaaaaccaacccacatatcagatgaagaagcaaacctcttcgccatgcaatcagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttattgtttggctactgttgctaa

SEQ ID NO: 8274 - DNA, 358 bp, Artificial
  MsCOMT deletion introduced by TALEN pair MsCOMT_T01.1
tctcacaaaaacctcatcaatcacaaccatgggttcaacaggtgaaactaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8275 - DNA, 358 bp, Artificial
  MsCOMT deletion introduced by TALEN pair MsCOMT_T01.1
tctcacaaaaacctcatcaatcacaaccatgggttcaacaggtgaaactaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagacggaaaggttcagagactttatggtttggctactgttgctaa

SEQ ID NO: 8276 - DNA, 358 bp, Artificial
  MsCOMT deletion introduced by TALEN pair MsCOMT_T01.1
tctcacaaaaacctcatcaatcacaaccatgggttcaacaggtgaaacgcaaatcccacatatcagatgaagaagcaaacctcttcgccatgcaattagcaagtgcttcagttcttcccatgattttaaaatcagctcttgaacttgatctcttagaaatcattgctaaagctggacctggagctcaaatttcacctattgaaattgcttctcaggtcccaacaactaaccctgatgcaccagttatgttggaacgaatgttgcgtctcttggcttggtacaatatcctcacttgttcagttcgtactcaacaagattgaaagaatcagagaatttatggtttggctactgttgctaa

SEQ ID NO: 8277 - DNA, 361 bp, Artificial
  MsCOMT deletion introduced by TALEN pair MsCOMT_T01.1
tctcacaaaaacctcatcaatcacaaccatgggttcaacaggtgaaacgcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8278 - DNA, 359 bp, Artificial
  MsCOMT deletion introduced by TALEN pair MsCOMT_T01.1
tctcacaaaaacctcatcaatcacaaccatgggttcaacaggtgaaacccaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagatcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8279 - DNA, 351 bp, Artificial
  MsCOMT deletion introduced by TALEN pair MsCOMT_T01.1
tctcacaaaaacctcatcaatcacaaccatgggttcaacaggtgaaacccacatatcatatgaagaagcacacctcttcgccatgcaactagcaagtccttcagttcttcccatgattttgaaatcagctcttgaacttgatctcttagaaatcattgctaaagctggacctggtgctcaaatttcacctattgaaattgcttctcagctaccaacagctaaccctgatgcaccagttatgttggaccgaatgttgcgtcgcttggcttgttacaatatcctcacttgttcagttcgtactcaacaagatggaaaggttcagagactttatggtttggctactgttgctaa

SEQ ID NO: 8280 - DNA, 351 bp, Artificial
  MsCOMT deletion introduced by TALEN pair MsCOMT_T01.1
tctcacaaaaacctcatcaatcacaaccatgggttcaacaggtgaaacccacatatcatatgaagaagcaaacctcttcgccctgcaattagcaagttcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 8281 - DNA, 351 bp, Artificial
  MsCOMT deletion introduced by TALEN pair MsCOMT_T01.1
tctcacaaaaacctcatcaatcacaaccatgggttcaacaggtgaaacccacatatcatatgaagaagcaaacctcttcgccctgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 8282 - DNA, 351 bp, Artificial
  MsCOMT deletion introduced by TALEN pair MsCOMT_T01.1
tctcacaaaaacctcatcaatcacaaccatgggttcaacaggtgaaacccacatatcatatgaagaagcaaacctcttcgccctgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8283 - DNA, 351 bp, Artificial
  MsCOMT deletion introduced by TALEN pair MsCOMT_T01.1
tctcacaaaaacctcatcaatcacaaccatgggttcaacaggtgaaacccacatatcatatgaagaagcaaacctcttcgccctgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8284 - DNA, 351 bp, Artificial
  MsCOMT deletion introduced by TALEN pair MsCOMT_T01.1
tctcacaaaaacctcatcaatcacaaccatgggttcaacaggtgaaacccacatatcatatgaagaagcaaacctcttcgccctgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8285 - DNA, 351 bp, Artificial
  MsCOMT deletion introduced by TALEN pair MsCOMT_T01.1
tctcacaaaaacctcatcaatcacaaccatgggttcaacaggtgaaacccacatatcatatgaagaagcaaacctcttcgccctgcaattagcaagtgcttcagttcttcccatgattttaaaatcagctcttgaacttgatctcttagaaatcattgctaaagctggacctggtgctcaaatttcacctattgaaattgcttctcagctcccaacaactaaccccgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8286 - DNA, 351 bp, Artificial
  MsCOMT deletion introduced by TALEN pair MsCOMT_T01.1
tctcacaaaaacctcatcaatcacaaccatgggttcaacaggtgaaacccacatatcatatgaagaagcaaacctcttcgccctgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgtaacaatatcctcacttgttcagttcgtactcaacaagatggaaaggttcagagactttatggtttggctactgttgctaa

SEQ ID NO: 8287 - DNA, 351 bp, Artificial
  MsCOMT deletion introduced by TALEN pair MsCOMT_T01.1
tctcacaaaaacctcatcaatcacaaccatgggttcaacaggtgaaacccacatatcatatgaagaagcaaacctcttcgccctgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8288 - DNA, 351 bp, Artificial
  MsCOMT deletion introduced by TALEN pair MsCOMT_T01.1
tctcacaaaaacctcatcaatcacaaccatgggttcaacaggtgaaacccacatatcatatgaagaagcaaacctcttcgccctgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8289 - DNA, 351 bp, Artificial
  MsCOMT deletion introduced by TALEN pair MsCOMT_T01.1
tctcacaaaaacctcatcaatcacaaccatgggttcaacaggtgaaacccacatatcatatgaagaagcaaacctcttcgccctgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggatcgaatgttgcgtctcttggcttgttacaatatcctcacttgttctgttcgtactcaacaagatggaaaggttcagagactttatggtttggctactgttgctaa

SEQ ID NO: 8290 - DNA, 351 bp, Artificial
  MsCOMT deletion introduced by TALEN pair MsCOMT_T01.1
tctcacaaaaacctcatcaatcacaaccatgggttcaacaggtgaaacccacatatcatatgaagaagcaaacctcttcgccctgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcatttgttcagttcgtactcaacaagatggaaagattcagagactttatggtttggctactgttgctaa

SEQ ID NO: 8291 - DNA, 351 bp, Artificial
  MsCOMT deletion introduced by TALEN pair MsCOMT_T01.1
tctcacaaaaacctcatcaatcacaaccatgggttcaacaggtgaaacccacatatcatatgaagaagcaaacctcttcgccctgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8292 - DNA, 351 bp, Artificial
  MsCOMT deletion introduced by TALEN pair MsCOMT_T01.1
tctcacaaaaacctcatcaatcacaaccatgggttcaacaggtgaaacccacatatcatatgaagaagcaaacctcttcgccctgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8293 - DNA, 351 bp, Artificial
  MsCOMT deletion introduced by TALEN pair MsCOMT_T01.1
tctcacaaaaacctcatcaatcacaaccatgggttcaacaggtgaaacccacatatcatatgaagaagcaaacctcttcgccctgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 8294 - DNA, 351 bp, Artificial
  MsCOMT deletion introduced by TALEN pair MsCOMT_T01.1
tctcacaaaaacctcatcaatcacaaccatgggttcaacaggtgaaacccacatatcatatgaagaagcaaacctcttcgccctgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8295 - DNA, 351 bp, Artificial
  MsCOMT deletion introduced by TALEN pair MsCOMT_T01.1
tctcacaaaaacctcatcaatcacaaccatgggttcaacaggtgaaacccacatatcatatgaagaagcaaacctcttcgccatgcaattagcaagttcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8296 - DNA, 351 bp, Artificial
  MsCOMT deletion introduced by TALEN pair MsCOMT_T01.1
tctcacaaaaacctcatcaatcacaaccatgggttcaacaggtgaaacccacatatcatatgaagaagcaaacctcttcgccatgcaattagcaagttcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8297 - DNA, 351 bp, Artificial
  MsCOMT deletion introduced by TALEN pair MsCOMT_T01.1
tctcacaaaaacctcatcaatcacaaccatgggttcaacaggtgaaacccacatatcatatgaagaagcaaacctcttcgccatgcaattagcaagttcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8298 - DNA, 351 bp, Artificial
  MsCOMT deletion introduced by TALEN pair MsCOMT_T01.1
tctcacaaaaacctcatcaatcacaaccatgggttcaacaggtgaaacccacatatcatatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8299 - DNA, 351 bp, Artificial
  MsCOMT deletion introduced by TALEN pair MsCOMT_T01.1
tctcacaaaaacctcatcaatcacaaccatgggttcaacaggtgaaacccacatatcatatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 8300 - DNA, 351 bp, Artificial
  MsCOMT deletion introduced by TALEN pair MsCOMT_T01.1
tctcacaaaaacctcatcaatcacaaccatgggttcaacaggtgaaacccacatatcatatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8301 - DNA, 351 bp, Artificial
  MsCOMT deletion introduced by TALEN pair MsCOMT_T01.1
tctcacaaaaacctcatcaatcacaaccatgggttcaacaggtgaaacccacatatcatatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttagtactcaacaagatggaaagattcagagactttatggtttggctactgttgctaa

SEQ ID NO: 8302 - DNA, 351 bp, Artificial
  MsCOMT deletion introduced by TALEN pair MsCOMT_T01.1
tctcacaaaaacctcatcaatcacaaccatgggttcaacaggtgaaacccacatatcatatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagggtcagagactttatggtttggctactgttgctaa

SEQ ID NO: 8303 - DNA, 351 bp, Artificial
  MsCOMT deletion introduced by TALEN pair MsCOMT_T01.1
tctcacaaaaacctcatcaatcacaaccatgggttcaacaggtgaaacccacatatcatatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8304 - DNA, 351 bp, Artificial
  MsCOMT deletion introduced by TALEN pair MsCOMT_T01.1
tctcacaaaaacctcatcaatcacaaccatgggttcaacaggtgaaacccacatatcatatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcttcacttgttcagttcgtactcaacaagatggaaagattcagagactttatggtttggctactgttgctaa

SEQ ID NO: 8305 - DNA, 351 bp, Artificial
  MsCOMT deletion introduced by TALEN pair MsCOMT_T01.1
tctcacaaaaacctcatcaatcacaaccatgggttcaacaggtgaaacccacatatcatatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 8306 - DNA, 351 bp, Artificial
  MsCOMT deletion introduced by TALEN pair MsCOMT_T01.1
tctcacaaaaacctcatcaatcacaaccatgggttcaacaggtgaaacccacatatcatatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8307 - DNA, 351 bp, Artificial
  MsCOMT deletion introduced by TALEN pair MsCOMT_T01.1
tctcacaaaaacctcatcaatcacaaccatgggttcaacaggtgaaacccacatatcatatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8308 - DNA, 351 bp, Artificial
  MsCOMT deletion introduced by TALEN pair MsCOMT_T01.1
tctcacaaaaacctcatcaatcacaaccatgggttcaacaggtgaaacccacatatcatatgaagaagcaaacctcttcgccatgcaactagcaagtgcttcagttcttcccattattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8309 - DNA, 351 bp, Artificial
  MsCOMT deletion introduced by TALEN pair MsCOMT_T01.1
tctcacaaaaacctcatcaatcacaaccatgggttcaacaggtgaaacccacatatcatatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8310 - DNA, 351 bp, Artificial
  MsCOMT deletion introduced by TALEN pair MsCOMT_T01.1
tctcacaaaaacctcatcaatcacaaccatgggttcaacaggtgaaacccacatatcatatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8311 - DNA, 351 bp, Artificial
  MsCOMT deletion introduced by TALEN pair MsCOMT_T01.1
tctcacaaaaacctcatcaatcacaaccatgggttcaacaggtgaaacccacatatcatatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 8312 - DNA, 351 bp, Artificial
  MsCOMT deletion introduced by TALEN pair MsCOMT_T01.1
tctcacaaaaacctcatcaatcacaaccatgggttcaacaggtgaaacccacatatcatatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8313 - DNA, 351 bp, Artificial
  MsCOMT deletion introduced by TALEN pair MsCOMT_T01.1
tctcacaaaaacctcatcaatcacaaccatgggttcaacaggtgaaacccacatatcatatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8314 - DNA, 351 bp, Artificial
  MsCOMT deletion introduced by TALEN pair MsCOMT_T01.1
tctcacaaaaacctcatcaatcacaaccatgggttcaacaggtgaaacccacatatcatatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8315 - DNA, 351 bp, Artificial
  MsCOMT deletion introduced by TALEN pair MsCOMT_T01.1
tctcacaaaaacctcatcaatcacaaccatgggttcaacaggtgaaacccacatatcatatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 8316 - DNA, 351 bp, Artificial
  MsCOMT deletion introduced by TALEN pair MsCOMT_T01.1
tctcacaaaaacctcatcaatcacaaccatgggttcaacaggtgaaacccacatatcatatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8317 - DNA, 351 bp, Artificial
  MsCOMT deletion introduced by TALEN pair MsCOMT_T01.1
tctcacaaaaacctcatcaatcacaaccatgggttcaacaggtgaaacccacatatcatatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8318 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaataagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 8319 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaatcaaacctcttcgccctgcaattagcaagttcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8320 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaatcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8321 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaatcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 8322 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaatcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8323 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaatcaaacctcttcgccatgcaactagcaagtccttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8324 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccctgcaattatcaagttcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8325 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccctgcaattatcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8326 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccctgcaattagcaagttcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 8327 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccctgcaattagcaagttcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8328 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccctgcaattagcaagttcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8329 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccctgcaattagcaagtgcttcagttcttcccattattttacaatcagctcttgaacttgatctcttagaaatcattgctaaagctggacctggtgctcaaattgcacctattgaaattgcttctcagctaccaacaactaaccctgatgcaccagttatgttggaccgaatgtgtcgtctcttggcttgttacaatatcctcacttgttcagttcgttctcaacaagatggaaaggttcagagcctttatggtttggctactgttgctaa

SEQ ID NO: 8330 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccctgcaattagcaagtgcttcagttcttcccattattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8331 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccctgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8332 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccctgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8333 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccctgcaattagcaagtgcttcagttcttcccatgattttacaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 8334 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccctgcaattagcaagtgcttcagttcttcccatgattttaaaatcagctcttgaacttgatctcttagaaatcattgctaaagctggacctggtgctcaaatttcatctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8335 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccctgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaagttcagagactttatggtttggctactgttgctaa

SEQ ID NO: 8336 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccctgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8337 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccctgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8338 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccctgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8339 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccctgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 8340 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccctgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 8341 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccctgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctat

SEQ ID NO: 8342 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccctgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8343 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccctgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8344 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccctgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8345 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccctgcaactatcaagttcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8346 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccctgcaactagcaagttcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8347 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccctgcaactagcaagttcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8348 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccctgcaactagcaagttcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8349 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccctgcaactagcaagtgcttcagttcttcccatgattttgcaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 8350 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccctgcaactagcaagtgcttcagttcttcccatgattttgaaatcagctcttgaacttggtctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8351 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccctgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8352 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccctgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8353 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccctgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 8354 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccctgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8355 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccctgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8356 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccctgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8357 - DNA, 350 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccctgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctatgttgctaa

SEQ ID NO: 8358 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccctgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagattttatggtttggctactgttgctaa

SEQ ID NO: 8359 - DNA, 350 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccctgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggttggctactgttgctaa

SEQ ID NO: 8360 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccctgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 8361 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccctgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8362 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcacttagcaagtacttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8363 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattatcaagttcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8364 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattatcaagttcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 8365 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8366 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagttcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8367 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagttcttcagttcttcccatgattttacaatcagctcttgaacttgatctcttagaaatcattgctaaagctggacctggtgctcaaatttcacctattgaaattgcttctcagctctcaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8368 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagttcttcagttcttcccatgattttacaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8369 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagttcttcagttcttcccatgattttacaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8370 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagttcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 8371 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagttcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 8372 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagttcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8373 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagttcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagatactttatggtttggctactgttgctaa

SEQ ID NO: 8374 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagttcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8375 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagttcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8376 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagttcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8377 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagttcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8378 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagttcttcagttcttcccatgattttaaaatcagctcttgaacttgatctcttagaaatcattgctaaagctggacctggtgctcaaatttcacctattgaaattgcttctcagctacaaacaactaaccctgatgcaccagttatgttggaccgaatgttgcgtcgcttggcttgttacaatatcctcacttgttcagttcgtactcaacaagatggaaaggttcagagactttatggtttggctactggtgctaa

SEQ ID NO: 8379 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcatctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8380 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 8381 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 8382 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggctggttacaatatcctcacttgttcagttcgtactcaacaagatggaaaagttcagagactttatggtttggctactgttgctaa

SEQ ID NO: 8383 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8384 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8385 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8386 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggctggttacaatatcctcacttgttcagttcgtactcaacaagatggaaaggttcagagactttatggtttggctactgttgctaa

SEQ ID NO: 8387 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8388 - DNA, 350 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttgctactgttgctaa

SEQ ID NO: 8389 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8390 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 8391 - DNA, 350 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 8392 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8393 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaagggttcagagactttatggtttggctactgttgctaa

SEQ ID NO: 8394 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgctcctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8395 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagtgcttcagttcttcccatgattttacaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 8396 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 8397 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 8398 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8399 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8400 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcggctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8401 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 8402 - DNA, 350 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaccctgatgcaccagttatgttggaccgaatgttgcgtctcttggcttgttacaatatcctcacttgttcggttcgtactcaacaagatggaaagattcagagactttatggtttggctactgttgctaa

SEQ ID NO: 8403 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8404 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8405 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8406 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8407 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggctcgttacaatatcctcacttgttcagttcgtactcaacaagatggaaaggttcagagactttatggtttggctactgttgctaa

SEQ ID NO: 8408 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 8409 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggctggttacaatatcctcacttgttcagttcgtactcaacaagatggaaaggttcagagactttatggtttggctactgttgctaa

SEQ ID NO: 8410 - DNA, 350 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 8411 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggcaactgttgctaa

SEQ ID NO: 8412 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatccttacttgttcagttcgtactcaacaagatggaaagattcagagactttatggtttggctactgttgctaa

SEQ ID NO: 8413 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaaggttgcgtctcttggcttgttacaatatcctcacttgttcagttcgtactcaacaagatggaaaggttcagagactttatggtttggctactgttgctaa

SEQ ID NO: 8414 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgctggaccgaatgttgcgtctcttggcttgttacaatatcctcacttgttcagttcgtactcaacaagatggaaagattcagagactttatggtttggctactgttgctaa

SEQ ID NO: 8415 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgacgcaccagttatgttggaccgaatgttgcgtctcttggcttgttacaatatcctcacttgttcagttcgtactcaacaagatggaaaggttcagagactttatggtttggctactgttgctaa

SEQ ID NO: 8416 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8417 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8418 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagacggaaaggttcagagactttatggtttggctactgttgctaa

SEQ ID NO: 8419 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 8420 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8421 - DNA, 350 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgcaa

SEQ ID NO: 8422 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtgctcaacaagatggaaaagttcagggactttatggtttggctactgttgctaa

SEQ ID NO: 8423 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgatggaccgaatgttgcgtctcttggcttgttacaatatcctcacttgttcagttcgtactcaacaagatggaaaggttcagagactttatggtttggctactgttgctaa

SEQ ID NO: 8424 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 8425 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctaagctcccaacaactaaccctgatgcaccagttatgttggaccgaatgttgcgtctcttggcttgttacaatatcctcacttgttcagttcgtactcaacaagatggaaagattcagagactttatggtttggccactgttgctaa

SEQ ID NO: 8426 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagtgcttcagttcttcccatgattttaaaatcagctcttgaacttgatctcttagaaatcattgctaaagctggacctggtgcccaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8427 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagtgcttcagttcttcccatgattttaaaatcagctcttgaacttgatctcttagaaaacattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8428 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagtgcttcagttcttcccatgattttaaaatcagctcttgaactcgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8429 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagtgcttcagttcttcccatgattttaaaatcagctcatgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8430 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagtgcttcagttcttcccatgattttaaaatcagctattgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8431 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagtgcttcagttcttcccatgattttaaaatcaactcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8432 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagtgcatcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 8433 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagtccttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8434 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaattagcaagtccttcagttcttcccatcattttaaaatcagctcttgaacttgatctcttagaaatcattgctaaagttggacctgttgctcaaatttcacctattgaaattgcttctcagctcccaacatcttaccctgatgcaccagttatgttggacccaatgttgcgtctctcggctagttacaatatcctcacttgttcagttcctactcaacaaaatggaaagcttcaaagcctttatggtttggctactcttgctca

SEQ ID NO: 8435 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaatcagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8436 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaattgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8437 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagttcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8438 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagttcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8439 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagttcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8440 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagttcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8441 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagttcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagattgaaaggttcagagactttatggtttggctactgttgctaa

SEQ ID NO: 8442 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagttcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8443 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagttcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8444 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagttcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8445 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagtgcttcagttcttcctatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8446 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagtgcttcagttcttcccatgattttggaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8447 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagtgcttcagttcttcccatgattttgaaatccgctcttgaactttatctcttagaaatccttgttaaagctggacctgatgctccaatttcacctattgaaattgcttctcagctcccaccaactaacccttatgcaccatttatgttgtaccgaatttttcgtctcttaacttattacaatatcctcactggttcatttcgtactcaacaatatacaaatattcacagactttatggtttacctactattgctaa

SEQ ID NO: 8448 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagtgcttcagttcttcccatgattttgaaatcagctcttgaacttgatctcttagaattcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8449 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagtgcttcagttcttcccatgattttgaaatcagctcttgaacttgatctcttagaaatcattgctaaagctggagctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8450 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8451 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 8452 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 8453 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 8454 - DNA, 350 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttaccatatcctcacttgttctgttcgtactcaacaagatggaaaggttcagaaactttatggtttggctactgttgcaa

SEQ ID NO: 8455 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8456 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8457 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8458 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 8459 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccggatgttgcgtctcttggcttgttacaatatcctcacttgttcagttcgtactcaacaagatggaaagattcagagactttatggtttggctactgttgctaa

SEQ ID NO: 8460 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8461 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8462 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagtccgtactcaacaagatggaaaggttcagagactttatggtttggctactgttgctaa

SEQ ID NO: 8463 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagctcgtactcaacaagatggaaagattcagagactttatggtttggctactgttgctaa

SEQ ID NO: 8464 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 8465 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctctgggcttgttacaatatcctcgcttgttcagttcgtactcaacaagatggaaaggttcagagactttatggtttggctactgttgctaa

SEQ ID NO: 8466 - DNA, 352 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgtttgctaa

SEQ ID NO: 8467 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 8468 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 8469 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8470 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8471 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 8472 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8473 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacattatcctcacttgttcagttcgtactcaacaagatggaaaggttcagagactttatggtttggctactgttgctaa

SEQ ID NO: 8474 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggtttgttacaatagcctcacttgttcagttcgtactcaacaagatggaaaggttcagagactttgtggtttggctacagtggctaa

SEQ ID NO: 8475 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagtccgtactcaacaagatggaaagattcagagactttatggtttggctactgttgctaa

SEQ ID NO: 8476 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactggtgctaa

SEQ ID NO: 8477 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 8478 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatgatttggctactgttgctaa

SEQ ID NO: 8479 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 8480 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatacaccagttatgttggaccgaatgttgcgtctcttggcttgttacaatatcctcacttgttcagttcgtactcaacaagatggaaaggttcagagactttatggtttggctactgttgctaa

SEQ ID NO: 8481 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctatcgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggcgactgttgctaa

SEQ ID NO: 8482 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagtgcttcagttcttcccatgattttgaaatcagctcttgaacttgatctcttagaaatcattgctaaagctggacctggtgcccaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8483 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagtgcttcagttcttcccatgattttgaaatcagctcttgaacttgatctcttagaaatcattgccaaagctggacctggtgctcaaatttcacctattggaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8484 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagtgcttcagttcttcccatgattttgaaatcagctctcgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8485 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagtgcttcagttcttcccatgattttaaaatcagctcttgaacttgatctctttgaaatcattgttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8486 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagtgcttcagttcttcccatgattttaaaatcagctcttgaacttgatctcttagaaatcattgctaaagctggacctggtgctcaagtttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 8487 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8488 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 8489 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 8490 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8491 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcatctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8492 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggatcgaatgttgcgtctcttggcttgttacaatatcctcacttgttcagttcgtactcaacaagatggaaaggttcagagactttatggtttggctactgttgctaa

SEQ ID NO: 8493 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8494 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8495 - DNA, 350 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggcactgttgctaa

SEQ ID NO: 8496 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8497 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8498 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagcctttatggtttggctactgttgctaa

SEQ ID NO: 8499 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcggttcgtactcaacaagatggaaaggttcagagactttatggtttggctactgttgctaa

SEQ ID NO: 8500 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagtgcttcagttcttcccatgatcttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8501 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatgcaactagcaagcgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8502 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgccatacaactatcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 8503 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaacctcttcgcaatgaaactagcaagcgtgtcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8504 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaagcaaaagtcgtagcattgaaattagcaagtgcttaagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8505 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaagaaacaaacctcttcgccatgcaactagcaagtacttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcccttgttcagttcgtacccaacaagatggaaaggttcagagactttatggtttggctactgttgctaa

SEQ ID NO: 8506 - DNA, 351 bp, Artificial
  MsCOMT deletion introduced by TALEN pair MsCOMT_T01.1
tctcacaaaaacctcatcaatcacaaccatgggttcaacaggtgaaacccacatatcagatgaacaagcaaacctcttcgccctgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8507 - DNA, 351 bp, Artificial
  MsCOMT deletion introduced by TALEN pair MsCOMT_T01.1
tctcacaaaaacctcatcaatcacaaccatgggttcaacaggtgaaacccacatatcagacgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8508 - DNA, 351 bp, Artificial
  MsCOMT deletion introduced by TALEN pair MsCOMT_T01.1
tctcacaaaaacctcatcaatcacaaccatgggttcaacaggtgaaacccacatatcacctaaagaaacaaaccacgtcgcaacacaactagcaagcgcgtcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8509 - DNA, 351 bp, Artificial
  MsCOMT deletion introduced by TALEN pair MsCOMT_T01.1
tctcacaaaaacctcatcaatcacaaccatgggttcaacaggtgaaacccacatatcacatgaagaagcaaacctcttcgccctgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagattttatggttttgctactggtgctaa

SEQ ID NO: 8510 - DNA, 351 bp, Artificial
  MsCOMT deletion introduced by TALEN pair MsCOMT_T01.1
tctcacaaaaacctcatcaatcacaaccatgggttcaacaggtgaaacccacatatcacatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcatctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8511 - DNA, 350 bp, Artificial
  MsCOMT deletion introduced by TALEN pair MsCOMT_T01.1
tctcacaaaaacctcatcaatcacaaccatgggttcaacaggtgaaacccacatatcacatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgtgctaa

SEQ ID NO: 8512 - DNA, 351 bp, Artificial
  MsCOMT deletion introduced by TALEN pair MsCOMT_T01.1
tctcacaaaaacctcatcaatcacaaccatgggttcaacaggtgaaacccacatatcacatgaagaagcaaacctcttcgccatgcaattagcaagctcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8513 - DNA, 351 bp, Artificial
  MsCOMT deletion introduced by TALEN pair MsCOMT_T01.1
tctcacaaaaacctcatcaatcacaaccatgggttcaacaggtgaaacccacatatcacatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8514 - DNA, 351 bp, Artificial
  MsCOMT deletion introduced by TALEN pair MsCOMT_T01.1
tctcacaaaaacctcatcaatcacaaccatgggttcaacaggtgaaacccacatatcacatgaagaagcaaacctcttcgccatgcaactagcaagtgcttcagttcttcccatgattttgaaatcagctcttgaacttgatctcttagaaatcattgctaaaactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8515 - DNA, 351 bp, Artificial
  MsCOMT deletion introduced by TALEN pair MsCOMT_T01.1
tctcacaaaaacctcatcaatcacaaccatgggttcaacaggtgaaacccacatataagatgaagaagcaaacctcttcgccatgcaactagcaagtgcttcagttcttcccatgattttgaaatcagctcttgaacttgatctcttagaaatcattgctaaagctggacctggtgctcaaatttcgcctattgaaattgcttctcagctcccaacaactaaccctgatgcaccagttatgttggaccgaatgttgcgtctcttggcttgttacaatatcctcacttgttcagttcgtactcaacaagatggaaaggttcagagactttctggtttggctactgttgctaa

SEQ ID NO: 8516 - DNA, 351 bp, Artificial
  MsCOMT deletion introduced by TALEN pair MsCOMT_T01.1
tctcacaaaaacctcatcaatcacaaccatgggttcaacaggtgaaacccacacatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8517 - DNA, 356 bp, Artificial
  MsCOMT deletion introduced by TALEN pair MsCOMT_T01.1
tctcacaaaaacctcatcaatcacaaccatgggttcaacaggtgaaacccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgtggctaa

SEQ ID NO: 8518 - DNA, 351 bp, Artificial
  MsCOMT deletion introduced by TALEN pair MsCOMT_T01.1
tctcacaaaaacctcatcaatcacaaccatgggttcaacaggtgaaacccaaatatcagctaacgaagcaaccgtcttcgccatgcaactctcaagtacttcagttcttcccatgattttaaaatcagctcttgaacttgatctcttagaaatcattgcttaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8519 - DNA, 359 bp, Artificial
  MsCOMT deletion introduced by TALEN pair MsCOMT_T01.1
tctcacaaaaacctcatcaatcacaaccatgggttcaacaggtgaaacccaaatacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8520 - DNA, 361 bp, Artificial
  MsCOMT deletion introduced by TALEN pair MsCOMT_T01.1
tctcacaaaaacctcatcaatcacaaccatgggttcaacaggtgaaacccaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctacctgttgctaa

SEQ ID NO: 8521 - DNA, 360 bp, Artificial
  MsCOMT deletion introduced by TALEN pair MsCOMT_T01.1
tctcacaaaaacctcatcaatcacaaccatgggttcaacaggtgaaacccaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8522 - DNA, 360 bp, Artificial
  MsCOMT deletion introduced by TALEN pair MsCOMT_T01.1
tctcacaaaaacctcatcaatcacaaccatgggttcaacaggtgaaacccaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8523 - DNA, 360 bp, Artificial
  MsCOMT deletion introduced by TALEN pair MsCOMT_T01.1
tctcacaaaaacctcatcaatcacaaccatgggttcaacaggtgaaacccaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8524 - DNA, 361 bp, Artificial
  MsCOMT deletion introduced by TALEN pair MsCOMT_T01.1
tctcacaaaaacctcatcaatcacaaccatgggttcaacaggtgaaacccaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 8525 - DNA, 357 bp, Artificial
  MsCOMT deletion introduced by TALEN pair MsCOMT_T01.1
tctcacaaaaacctcatcaatcacaaccatgggttcaacaggtgaaacccaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8526 - DNA, 357 bp, Artificial
  MsCOMT deletion introduced by TALEN pair MsCOMT_T01.1
tctcacaaaaacctcatcaatcacaaccatgggttcaacaggtgaaacccaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8527 - DNA, 357 bp, Artificial
  MsCOMT deletion introduced by TALEN pair MsCOMT_T01.1
tctcacaaaaacctcatcaatcacaaccatgggttcaacaggtgaaacccaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8528 - DNA, 357 bp, Artificial
  MsCOMT deletion introduced by TALEN pair MsCOMT_T01.1
tctcacaaaaacctcatcaatcacaaccatgggttcaacaggtgaaacccaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 8529 - DNA, 357 bp, Artificial
  MsCOMT deletion introduced by TALEN pair MsCOMT_T01.1
tctcacaaaaacctcatcaatcacaaccatgggttcaacaggtgaaacccaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8530 - DNA, 355 bp, Artificial
  MsCOMT deletion introduced by TALEN pair MsCOMT_T01.1
tctcacaaaaacctcatcaatcacaaccatgggttcaacaggtgaaacccaaacacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8531 - DNA, 360 bp, Artificial
  MsCOMT deletion introduced by TALEN pair MsCOMT_T01.1
tctcacaaaaacctcatcaatcacaaccatgggttcaacaggtgaaacccaaacaacccacatatcatatgaagaaccaaacctcttcgccatgcaactagcaagtgcttcagttcttcccatgattttgaaatcagctcttgaacttgatctcttagaaatcattgctaaagctgcacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8532 - DNA, 355 bp, Artificial
  MsCOMT deletion introduced by TALEN pair MsCOMT_T01.1
tctcacaaaaacctcatcaatcacaaccatgggttcaacaggtgaaaccaacccacatatcatatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8533 - DNA, 355 bp, Artificial
  MsCOMT deletion introduced by TALEN pair MsCOMT_T01.1
tctcacaaaaacctcatcaatcacaaccatgggttcaacaggtgaaaccaacccacatatcagatgaagaagcaaacctcttcgccatgtaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtatgggtactgttgctaa

SEQ ID NO: 8534 - DNA, 355 bp, Artificial
  MsCOMT deletion introduced by TALEN pair MsCOMT_T01.1
tctcacaaaaacctcatcaatcacaaccatgggttcaacaggtgaaaccaacccacatatcagatgaagaagcaaacctcttcgccatgcagctagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8535 - DNA, 355 bp, Artificial
  MsCOMT deletion introduced by TALEN pair MsCOMT_T01.1
tctcacaaaaacctcatcaatcacaaccatgggttcaacaggtgaaaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8536 - DNA, 355 bp, Artificial
  MsCOMT deletion introduced by TALEN pair MsCOMT_T01.1
tctcacaaaaacctcatcaatcacaaccatgggttcaacaggtgaaaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8537 - DNA, 355 bp, Artificial
  MsCOMT deletion introduced by TALEN pair MsCOMT_T01.1
tctcacaaaaacctcatcaatcacaaccatgggttcaacaggtgaaaccaacccacatatcagatgaagaagcaaacctcttcgccatgcaattagcaagtgcttcagttcttcccatgattttaaaatcagctcttgaacttgatctcttagaaatccttgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8538 - DNA, 355 bp, Artificial
  MsCOMT deletion introduced by TALEN pair MsCOMT_T01.1
tctcacaaaaacctcatcaatcacaaccatgggttcaacaggtgaaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 8539 - DNA, 355 bp, Artificial
  MsCOMT deletion introduced by TALEN pair MsCOMT_T01.1
tctcacaaaaacctcatcaatcacaaccatgggttcaacaggtgaaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgtgggaccgaatgttgcgtctcttggcttgttacaatatcctcacttgttgagttcgtactcaacaagatggaaaggttcagagactttatggtttggctactgttgctaa

SEQ ID NO: 8540 - DNA, 355 bp, Artificial
  MsCOMT deletion introduced by TALEN pair MsCOMT_T01.1
tctcacaaaaacctcatcaatcacaaccatgggttcaacaggtgaaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8541 - DNA, 355 bp, Artificial
  MsCOMT deletion introduced by TALEN pair MsCOMT_T01.1
tctcacaaaaacctcatcaatcacaaccatgggttcaacaggtgaaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8542 - DNA, 355 bp, Artificial
  MsCOMT deletion introduced by TALEN pair MsCOMT_T01.1
tctcacaaaaacctcatcaatcacaaccatgggttcaacaggtgaaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8543 - DNA, 355 bp, Artificial
  MsCOMT deletion introduced by TALEN pair MsCOMT_T01.1
tctcacaaaaacctcatcaatcacaaccatgggttcaacaggtgaaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 8544 - DNA, 355 bp, Artificial
  MsCOMT deletion introduced by TALEN pair MsCOMT_T01.1
tctcacaaaaacctcatcaatcacaaccatgggttcaacaggtgaaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 8545 - DNA, 355 bp, Artificial
  MsCOMT deletion introduced by TALEN pair MsCOMT_T01.1
tctcacaaaaacctcatcaatcacaaccatgggttcaacaggtgaaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 8546 - DNA, 355 bp, Artificial
  MsCOMT deletion introduced by TALEN pair MsCOMT_T01.1
tctcacaaaaacctcatcaatcacaaccatgggttcaacaggtgaaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 8547 - DNA, 355 bp, Artificial
  MsCOMT deletion introduced by TALEN pair MsCOMT_T01.1
tctcacaaaaacctcatcaatcacaaccatgggttcaacaggtgaaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8548 - DNA, 355 bp, Artificial
  MsCOMT deletion introduced by TALEN pair MsCOMT_T01.1
tctcacaaaaacctcatcaatcacaaccatgggttcaacaggtgaaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8549 - DNA, 355 bp, Artificial
  MsCOMT deletion introduced by TALEN pair MsCOMT_T01.1
tctcacaaaaacctcatcaatcacaaccatgggttcaacaggtgaaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8550 - DNA, 355 bp, Artificial
  MsCOMT deletion introduced by TALEN pair MsCOMT_T01.1
tctcacaaaaacctcatcaatcacaaccatgggttcaacaggtgaaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggatcgaatgttgcgtctcttggcttgttacaatatcctcacttgttcagttcgtactcaacaagatggaaaagttcagagactttatggtttggctactgttgctaa

SEQ ID NO: 8551 - DNA, 355 bp, Artificial
  MsCOMT deletion introduced by TALEN pair MsCOMT_T01.1
tctcacaaaaacctcatcaatcacaaccatgggttcaacaggtgaaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8552 - DNA, 355 bp, Artificial
  MsCOMT deletion introduced by TALEN pair MsCOMT_T01.1
tctcacaaaaacctcatcaatcacaaccatgggttcaacaggtgaaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8553 - DNA, 355 bp, Artificial
  MsCOMT deletion introduced by TALEN pair MsCOMT_T01.1
tctcacaaaaacctcatcaatcacaaccatgggttcaacaggtgaaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8554 - DNA, 355 bp, Artificial
  MsCOMT deletion introduced by TALEN pair MsCOMT_T01.1
tctcacaaaaacctcatcaatcacaaccatgggttcaacaggtgaaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctctcttgttcagttcgtactcaacaagatggaaaggttcagagactttatggtttggctactgttgctaa

SEQ ID NO: 8555 - DNA, 355 bp, Artificial
  MsCOMT deletion introduced by TALEN pair MsCOMT_T01.1
tctcacaaaaacctcatcaatcacaaccatgggttcaacaggtgaaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcactcgttcagttcgtactcaacaagatggaaaagttcagagactttatggtttggctactgttgctaa

SEQ ID NO: 8556 - DNA, 355 bp, Artificial
  MsCOMT deletion introduced by TALEN pair MsCOMT_T01.1
tctcacaaaaacctcatcaatcacaaccatgggttcaacaggtgaaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcatcaagatggaaaggttcagagactttatggtttggctactgttgctaa

SEQ ID NO: 8557 - DNA, 355 bp, Artificial
  MsCOMT deletion introduced by TALEN pair MsCOMT_T01.1
tctcacaaaaacctcatcaatcacaaccatgggttcaacaggtgaaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgagtcacttggattgttgcagtatccgcaatttttcagttcgttctcaacaagacagaaaggttcagtcaccttatggttgggctaaggttgataa

SEQ ID NO: 8558 - DNA, 355 bp, Artificial
  MsCOMT deletion introduced by TALEN pair MsCOMT_T01.1
tctcacaaaaacctcatcaatcacaaccatgggttcaacaggtgaaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggtccagagactttatggtttggctactgttgctaa

SEQ ID NO: 8559 - DNA, 355 bp, Artificial
  MsCOMT deletion introduced by TALEN pair MsCOMT_T01.1
tctcacaaaaacctcatcaatcacaaccatgggttcaacaggtgaaaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8560 - DNA, 354 bp, Artificial
  MsCOMT deletion introduced by TALEN pair MsCOMT_T01.1
tctcacaaaaacctcatcaatcacaaccatgggttcaacaggtgaaaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 8561 - DNA, 355 bp, Artificial
  MsCOMT deletion introduced by TALEN pair MsCOMT_T01.1
tctcacaaaaacctcatcaatcacaaccatgggttcaacaggtgaaaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8562 - DNA, 355 bp, Artificial
  MsCOMT deletion introduced by TALEN pair MsCOMT_T01.1
tctcacaaaaacctcatcaatcacaaccatgggttcaacaggtgaaaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8563 - DNA, 354 bp, Artificial
  MsCOMT deletion introduced by TALEN pair MsCOMT_T01.1
tctcacaaaaacctcatcaatcacaaccatgggttcaacaggtgaaaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgtaa

SEQ ID NO: 8564 - DNA, 355 bp, Artificial
  MsCOMT deletion introduced by TALEN pair MsCOMT_T01.1
tctcacaaaaacctcatcaatcacaaccatgggttcaacaggtgaaaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8565 - DNA, 355 bp, Artificial
  MsCOMT deletion introduced by TALEN pair MsCOMT_T01.1
tctcacaaaaacctcatcaatcacaaccatgggttcaacaggtgaaaccaacccacatatcagatgaagaagcaaacctcttcgccatgcaactagcaagtgcttcagttcttcccatgattttaaaatcagctcttgaacttgatctcttagaaatcattgctaaagctggacctggtactcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8566 - DNA, 355 bp, Artificial
  MsCOMT deletion introduced by TALEN pair MsCOMT_T01.1
tctcacaaaaacctcatcaatcacaaccatgggttcaacaggtgaaaccaacccacatatcagatgaagaagcaaacctcttcgccatgcaactagcaagtgcttcagctcttcccatgattttgaaatcagctcttgaatttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8567 - DNA, 355 bp, Artificial
  MsCOMT deletion introduced by TALEN pair MsCOMT_T01.1
tctcacaaaaacctcatcaatcacaaccatgggttcaacaggtgaaaccaacccacatatcagatgaagaagcaaacctcttcgccatgcaactagcaagggcttcagttcttcccatgattttgaaatcagctcttgaacttgatctcttagaaatcattgctaaagctggacctggtgctcaaatttcgcctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8568 - DNA, 355 bp, Artificial
  MsCOMT deletion introduced by TALEN pair MsCOMT_T01.1
tctcacaaaaacctcatcaatcacaaccatgggttcaacaggtgaaaccaacccacatatcagatgaagaagcaaacctcttcgccatgcaactagcaagggcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8569 - DNA, 355 bp, Artificial
  MsCOMT deletion introduced by TALEN pair MsCOMT_T01.1
tctcacaaaaacctcatcaatcacaaccatgggttcaacaggtgaaaccaacccacatatcagatgaagaagcaaacctcttcgccatgcaactagcaagggcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctctcttgttcagttcgtactcaacaagatggaaagattcagagactttatggtttggctactgttgctaa

SEQ ID NO: 8570 - DNA, 355 bp, Artificial
  MsCOMT deletion introduced by TALEN pair MsCOMT_T01.1
tctcacaaaaacctcatcaatcacaaccatgggttcaacaggtgaaaccaacccacatatcagatgaagaagcaaacctcttcgccacgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8571 - DNA, 354 bp, Artificial
  MsCOMT deletion introduced by TALEN pair MsCOMT_T01.1
tctcacaaaaacctcatcaatcacaaccatgggttcaacaggtgaaaccaacccacaatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8572 - DNA, 353 bp, Artificial
  MsCOMT deletion introduced by TALEN pair MsCOMT_T01.1
tctcacaaaaacctcatcaatcacaaccatgggttcaacaggtgaaacacccacatatcagattaagaagcaaacctcttcgccatgccattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8573 - DNA, 353 bp, Artificial
  MsCOMT deletion introduced by TALEN pair MsCOMT_T01.1
tctcacaaaaacctcatcaatcacaaccatgggttcaacaggtgaaacacccacatatcagattaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8574 - DNA, 353 bp, Artificial
  MsCOMT deletion introduced by TALEN pair MsCOMT_T01.1
tctcacaaaaacctcatcaatcacaaccatgggttcaacaggtgaaacacccacatatcagattaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8575 - DNA, 352 bp, Artificial
  MsCOMT deletion introduced by TALEN pair MsCOMT_T01.1
tctcacaaaaacctcatcaatcacaaccatgggttcaacaggtgaaacacccacatatcagatgaagaagcaaacctcttcgccatgtaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 8576 - DNA, 353 bp, Artificial
  MsCOMT deletion introduced by TALEN pair MsCOMT_T01.1
tctcacaaaaacctcatcaatcacaaccatgggttcaacaggtgaaacacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8577 - DNA, 353 bp, Artificial
  MsCOMT deletion introduced by TALEN pair MsCOMT_T01.1
tctcacaaaaacctcatcaatcacaaccatgggttcaacaggtgaaacacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 8578 - DNA, 353 bp, Artificial
  MsCOMT deletion introduced by TALEN pair MsCOMT_T01.1
tctcacaaaaacctcatcaatcacaaccatgggttcaacaggtgaaacacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 8579 - DNA, 353 bp, Artificial
  MsCOMT deletion introduced by TALEN pair MsCOMT_T01.1
tctcacaaaaacctcatcaatcacaaccatgggttcaacaggtgaaacacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8580 - DNA, 353 bp, Artificial
  MsCOMT deletion introduced by TALEN pair MsCOMT_T01.1
tctcacaaaaacctcatcaatcacaaccatgggttcaacaggtgaaacacccacatatcagatgaagaagcaaacctcttcgccatgcaactagcaattgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 8581 - DNA, 353 bp, Artificial
  MsCOMT deletion introduced by TALEN pair MsCOMT_T01.1
tctcacaaaaacctcatcaatcacaaccatgggttcaacaggtgaaacacccacatatcagatgaagaagcaaacctcttcgccatgcaactagcaattgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcatctcttggcttgttacaatatcctcacttgttcagttcgtactcaacaagatggaaaggttcagagactttatggtttggctactgttgctaa

SEQ ID NO: 8582 - DNA, 353 bp, Artificial
  MsCOMT deletion introduced by TALEN pair MsCOMT_T01.1
tctcacaaaaacctcatcaatcacaaccatgggttcaacaggtgaaacacccacatatcagatgaagaagcaaacctcttcgccatgcaactagcaattgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8583 - DNA, 353 bp, Artificial
  MsCOMT deletion introduced by TALEN pair MsCOMT_T01.1
tctcacaaaaacctcatcaatcacaaccatgggttcaacaggtgaaacacccacatatcagatgaagaagcaaacctcttcgccatgcaactagcaattgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8584 - DNA, 353 bp, Artificial
  MsCOMT deletion introduced by TALEN pair MsCOMT_T01.1
tctcacaaaaacctcatcaatcacaaccatgggttcaacaggtgaaacacccacatatcagatgaagaagcaaacctcttcgccatgcaactagcaattgcttcagttcttcccatgattttgaaatcagctctcgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8585 - DNA, 353 bp, Artificial
  MsCOMT deletion introduced by TALEN pair MsCOMT_T01.1
tctcacaaaaacctcatcaatcacaaccatgggttcaacaggtgaaacacccacatatcagatgaagaagcaaacctcttcgccatgcaactagcaattgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 8586 - DNA, 353 bp, Artificial
  MsCOMT deletion introduced by TALEN pair MsCOMT_T01.1
tctcacaaaaacctcatcaatcacaaccatgggttcaacaggtgaaacacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8587 - DNA, 353 bp, Artificial
  MsCOMT deletion introduced by TALEN pair MsCOMT_T01.1
tctcacaaaaacctcatcaatcacaaccatgggttcaacaggtgaaacacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8588 - DNA, 353 bp, Artificial
  MsCOMT deletion introduced by TALEN pair MsCOMT_T01.1
tctcacaaaaacctcatcaatcacaaccatgggttcaacaggtgaaacacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8589 - DNA, 353 bp, Artificial
  MsCOMT deletion introduced by TALEN pair MsCOMT_T01.1
tctcacaaaaacctcatcaatcacaaccatgggttcaacaggtgaaacacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8590 - DNA, 353 bp, Artificial
  MsCOMT deletion introduced by TALEN pair MsCOMT_T01.1
tctcacaaaaacctcatcaatcacaaccatgggttcaacaggtgaaacacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatattgcgtctcttggcttgttacaatatcctcacttgttcagttcgtactcaacaagatggaaaggttcagagactttatggtttggctactgttgctaa

SEQ ID NO: 8591 - DNA, 353 bp, Artificial
  MsCOMT deletion introduced by TALEN pair MsCOMT_T01.1
tctcacaaaaacctcatcaatcacaaccatgggttcaacaggtgaaacacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8592 - DNA, 353 bp, Artificial
  MsCOMT deletion introduced by TALEN pair MsCOMT_T01.1
tctcacaaaaacctcatcaatcacaaccatgggttcaacaggtgaaacacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8593 - DNA, 353 bp, Artificial
  MsCOMT deletion introduced by TALEN pair MsCOMT_T01.1
tctcacaaaaacctcatcaatcacaaccatgggttcaacaggtgaaacacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8594 - DNA, 353 bp, Artificial
  MsCOMT deletion introduced by TALEN pair MsCOMT_T01.1
tctcacaaaaacctcatcaatcacaaccatgggttcaacaggtgaaacacccacatatcagatgaagaagcaaacctcttcgccatgcaactagcaagtgcttcagttcttcccatgattttgaaatcagctcttgaacttgatctcttagaaatcattgctaaagctggacctggtactcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8595 - DNA, 353 bp, Artificial
  MsCOMT deletion introduced by TALEN pair MsCOMT_T01.1
tctcacaaaaacctcatcaatcacaaccatgggttcaacaggtgaaacacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8596 - DNA, 353 bp, Artificial
  MsCOMT deletion introduced by TALEN pair MsCOMT_T01.1
tctcacaaaaacctcatcaatcacaaccatgggttcaacaggtgaaacacccacatatcagatgaagaagcaaacctcttcgccatgcaactagcaagtgcttcagttcttcccataattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8597 - DNA, 353 bp, Artificial
  MsCOMT deletion introduced by TALEN pair MsCOMT_T01.1
tctcacaaaaacctcatcaatcacaaccatgggttcaacaggtgaaacacccacatatcagatgaagaagcaaaaagattcgccatgcaattagcaagtgcttcagttcttcccatgattttaaaatcagctcttgaacttgatctcttagaaatcattgctaaagctggacctggtgctcaaatttcacctgttcttattgcttctcagctaccgacaactaaccctgatgcaccagttatgttggaccgaatgttgcgtctcttggcttgttacactttcctcacttgttcagttcgtactcaacaagatggaaaggttcacctcctttatggtttggctactgttgctaa

SEQ ID NO: 8598 - DNA, 366 bp, Artificial
  MsCOMT deletion introduced by TALEN pair MsCOMT_T01.1
tctcacaaaaacctcatcaatcacaaccatgggttcaacaggtgaaacaccaatcctaccaaccatcctatcagataaagctgcaatcctcttcacgatgtaattatcaactgcttaagttcttcccatgattttcaaatctgctcttgaacttgatcttttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8599 - DNA, 357 bp, Artificial
  MsCOMT deletion introduced by TALEN pair MsCOMT_T01.1
tctcacaaaaacctcatcaatcacaaccatgggttcaacaggtgaaacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8600 - DNA, 351 bp, Artificial
  MsCOMT deletion introduced by TALEN pair MsCOMT_T01.1
tctcacaaaaacctcatcaatcacaaccatgggttcaacaggtgaaacacaaatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaaccactaaccctgatgcaccagttatgttggaccgaatgttgcgtctctgcgcttgttacaatatcctcacttgttcagttcgtactcaagaagaaggaaagggtcagagaatttatggtttggctacttgtgctaa

SEQ ID NO: 8601 - DNA, 360 bp, Artificial
  MsCOMT deletion introduced by TALEN pair MsCOMT_T01.1
tctcacaaaaacctcatcaatcacaaccatgggttcaacaggtgaaacacaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8602 - DNA, 360 bp, Artificial
  MsCOMT deletion introduced by TALEN pair MsCOMT_T01.1
tctcacaaaaacctcatcaatcacaaccatgggttcaacaggtgaaacacaaataacccacatatcagatgaagaagcaaacctcttcgccatgcaattagcaagagcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8603 - DNA, 360 bp, Artificial
  MsCOMT deletion introduced by TALEN pair MsCOMT_T01.1
tctcacaaaaacctcatcaatcacaaccatgggttcaacaggtgaaacacaaataacccacatatcagaggaagaagaaaacctcttcgccatgcaactagcaagtgcttcagttcttcccatgattttgaaatcagctcttgaacttgatctcttagaaatcattgctaaagctggacctggtgctcaaatttcaactattgaaattgcttctcagctgccaacaactaaccctgatgcaccagttatgttggaccgaatgttgcgtctcttggcttgttccaatctcctctcttgttcagttcgtactcaacaagatggaaagtttcacagcctttatggtttggctactgttgctaa

SEQ ID NO: 8604 - DNA, 358 bp, Artificial
  MsCOMT deletion introduced by TALEN pair MsCOMT_T01.1
tctcacaaaaacctcatcaatcacaaccatgggttcaacaggtgaaacacaaaccccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8605 - DNA, 358 bp, Artificial
  MsCOMT deletion introduced by TALEN pair MsCOMT_T01.1
tctcacaaaaacctcatcaatcacaaccatgggttcaacaggtgaaacacaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8606 - DNA, 354 bp, Artificial
  MsCOMT deletion introduced by TALEN pair MsCOMT_T01.1
tctcacaaaaacctcatcaatcacaaccatgggttcaacaggtgaaacaacccacatatcagatgaagaagcaaacctcttcgccatgcaattagcaattgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 8607 - DNA, 354 bp, Artificial
  MsCOMT deletion introduced by TALEN pair MsCOMT_T01.1
tctcacaaaaacctcatcaatcacaaccatgggttcaacaggtgaaacaacccacatatcagatgaagaagcaaacctcttcgccatgcaattagcaagtgcttcagttcttcccatgattttgaaatcagctcttgaacttgatctctcagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8608 - DNA, 354 bp, Artificial
  MsCOMT deletion introduced by TALEN pair MsCOMT_T01.1
tctcacaaaaacctcatcaatcacaaccatgggttcaacaggtgaaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8609 - DNA, 354 bp, Artificial
  MsCOMT deletion introduced by TALEN pair MsCOMT_T01.1
tctcacaaaaacctcatcaatcacaaccatgggttcaacaggtgaaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8610 - DNA, 354 bp, Artificial
  MsCOMT deletion introduced by TALEN pair MsCOMT_T01.1
tctcacaaaaacctcatcaatcacaaccatgggttcaacaggtgaaacaacccacatatcagatgaagaagcaaacctcttcgccatgcaattagcaagcgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8611 - DNA, 361 bp, Artificial
  MsCOMT deletion introduced by TALEN pair MsCOMT_T01.1
tctcacaaaaacctcatcaatcacaaccatgggttcaacaggtgaaaatcaaatcaacccacatatcagatgaagaagcaaacttcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8612 - DNA, 360 bp, Artificial
  MsCOMT deletion introduced by TALEN pair MsCOMT_T01.1
tctcacaaaaacctcatcaatcacaaccatgggttcaacaggtgaaaatcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8613 - DNA, 366 bp, Artificial
  MsCOMT deletion introduced by TALEN pair MsCOMT_T01.1
tctcacaaaaacctcatcaatcacaaccatgggttcaacaggtgaaaatcaaataaagacaaaacacatatcagattaagaagcaaacctgttcgccatgcaattaggaattgcttcagagcttcccatgattttaaaatcagctcttgaactagagctcttagaaatcattgctaaagctgcacctgatgctcaaatttcacctattgaaattgcttctcagcacccaacaactaaccctgatgcaccagttatgttggaccgaatgttgcgtctcttggcttgttacaatatcctcacttgttcatttcgtactcaacaagatggaaaggttcagagcctatatggtttggctactgttgctaa

SEQ ID NO: 8614 - DNA, 332 bp, Artificial
  MsCOMT deletion introduced by TALEN pair MsCOMT_T01.1
tctcacaaaaacctcatcaatcacaaccatgggttcaacaggtgaaaagcaaaccttttcgccaggcaattagcaagtgcttgagttcttcccatgattttaaaatcacctcttgaacttgttctcttagaaatcattgctaaagttggacctggtgctcaaatttcacctattgaaattgctgctcagctcccagcaactacccctgatgcaccagttatgttggaccgaatgttgcgtctcttggcttgttacaatatcctcacttgttcagttcgtactcaacaagatggaaaagttcagagactttatggttgggctactgttgctaa

SEQ ID NO: 8615 - DNA, 332 bp, Artificial
  MsCOMT deletion introduced by TALEN pair MsCOMT_T01.1
tctcacaaaaacctcatcaatcacaaccatgggttcaacaggtgaaaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8616 - DNA, 332 bp, Artificial
  MsCOMT deletion introduced by TALEN pair MsCOMT_T01.1
tctcacaaaaacctcatcaatcacaaccatgggttcaacaggtgaaaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8617 - DNA, 332 bp, Artificial
  MsCOMT deletion introduced by TALEN pair MsCOMT_T01.1
tctcacaaaaacctcatcaatcacaaccatgggttcaacaggtgaaaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8618 - DNA, 332 bp, Artificial
  MsCOMT deletion introduced by TALEN pair MsCOMT_T01.1
tctcacaaaaacctcatcaatcacaaccatgggttcaacaggtgaaaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 8619 - DNA, 332 bp, Artificial
  MsCOMT deletion introduced by TALEN pair MsCOMT_T01.1
tctcacaaaaacctcatcaatcacaaccatgggttcaacaggtgaaaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8620 - DNA, 332 bp, Artificial
  MsCOMT deletion introduced by TALEN pair MsCOMT_T01.1
tctcacaaaaacctcatcaatcacaaccatgggttcaacaggtgaaaagcaaacctcttcgccatgcaattagcaagtgcttcagttcttcccatgattttaaaatcagctcttgaacttgctctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8621 - DNA, 332 bp, Artificial
  MsCOMT deletion introduced by TALEN pair MsCOMT_T01.1
tctcacaaaaacctcatcaatcacaaccatgggttcaacaggtgaaaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8622 - DNA, 332 bp, Artificial
  MsCOMT deletion introduced by TALEN pair MsCOMT_T01.1
tctcacaaaaacctcatcaatcacaaccatgggttcaacaggtgaaaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 8623 - DNA, 332 bp, Artificial
  MsCOMT deletion introduced by TALEN pair MsCOMT_T01.1
tctcacaaaaacctcatcaatcacaaccatgggttcaacaggtgaaaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 8624 - DNA, 332 bp, Artificial
  MsCOMT deletion introduced by TALEN pair MsCOMT_T01.1
tctcacaaaaacctcatcaatcacaaccatgggttcaacaggtgaaaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8625 - DNA, 332 bp, Artificial
  MsCOMT deletion introduced by TALEN pair MsCOMT_T01.1
tctcacaaaaacctcatcaatcacaaccatgggttcaacaggtgaaaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8626 - DNA, 332 bp, Artificial
  MsCOMT deletion introduced by TALEN pair MsCOMT_T01.1
tctcacaaaaacctcatcaatcacaaccatgggttcaacaggtgaaaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 8627 - DNA, 332 bp, Artificial
  MsCOMT deletion introduced by TALEN pair MsCOMT_T01.1
tctcacaaaaacctcatcaatcacaaccatgggttcaacaggtgaaaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 8628 - DNA, 332 bp, Artificial
  MsCOMT deletion introduced by TALEN pair MsCOMT_T01.1
tctcacaaaaacctcatcaatcacaaccatgggttcaacaggtgaaaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggtccgaatgttgcgtctcttggcttgttacaatatcctcacttgttcagttcgtactcaacaagatggaaagattcagagactttatggtttggctactgttgctaa

SEQ ID NO: 8629 - DNA, 332 bp, Artificial
  MsCOMT deletion introduced by TALEN pair MsCOMT_T01.1
tctcacaaaaacctcatcaatcacaaccatgggttcaacaggtgaaaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8630 - DNA, 332 bp, Artificial
  MsCOMT deletion introduced by TALEN pair MsCOMT_T01.1
tctcacaaaaacctcatcaatcacaaccatgggttcaacaggtgaaaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8631 - DNA, 332 bp, Artificial
  MsCOMT deletion introduced by TALEN pair MsCOMT_T01.1
tctcacaaaaacctcatcaatcacaaccatgggttcaacaggtgaaaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8632 - DNA, 332 bp, Artificial
  MsCOMT deletion introduced by TALEN pair MsCOMT_T01.1
tctcacaaaaacctcatcaatcacaaccatgggttcaacaggtgaaaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagaggctttatggtttggctactgttgctaa

SEQ ID NO: 8633 - DNA, 332 bp, Artificial
  MsCOMT deletion introduced by TALEN pair MsCOMT_T01.1
tctcacaaaaacctcatcaatcacaaccatgggttcaacaggtgaaaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaatggttcagagactttatggtttggctactgttgctaa

SEQ ID NO: 8634 - DNA, 332 bp, Artificial
  MsCOMT deletion introduced by TALEN pair MsCOMT_T01.1
tctcacaaaaacctcatcaatcacaaccatgggttcaacaggtgaaaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8635 - DNA, 332 bp, Artificial
  MsCOMT deletion introduced by TALEN pair MsCOMT_T01.1
tctcacaaaaacctcatcaatcacaaccatgggttcaacaggtgaaaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 8636 - DNA, 332 bp, Artificial
  MsCOMT deletion introduced by TALEN pair MsCOMT_T01.1
tctcacaaaaacctcatcaatcacaaccatgggttcaacaggtgaaaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgatggaccgaatgttgcgtctcttggcttgttacaatatcctcacttgttcagttcgtactcaacaagatggaagggttcagagactttatggtttggctactgttgctaa

SEQ ID NO: 8637 - DNA, 332 bp, Artificial
  MsCOMT deletion introduced by TALEN pair MsCOMT_T01.1
tctcacaaaaacctcatcaatcacaaccatgggttcaacaggtgaaaagcaaacctcttcgccatgcaattagcaagtgcttcagttcttcccatgatttcgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8638 - DNA, 332 bp, Artificial
  MsCOMT deletion introduced by TALEN pair MsCOMT_T01.1
tctcacaaaaacctcatcaatcacaaccatgggttcaacaggtgaaaagcaaacctcttcgccatgcaattagcaagtgcttcagttcttcccatgatttcaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8639 - DNA, 332 bp, Artificial
  MsCOMT deletion introduced by TALEN pair MsCOMT_T01.1
tctcacaaaaacctcatcaatcacaaccatgggttcaacaggtgaaaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8640 - DNA, 333 bp, Artificial
  MsCOMT deletion introduced by TALEN pair MsCOMT_T01.1
tctcacaaaaacctcatcaatcacaaccatgggttcaacaggtgaaaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctacctgttgctaa

SEQ ID NO: 8641 - DNA, 332 bp, Artificial
  MsCOMT deletion introduced by TALEN pair MsCOMT_T01.1
tctcacaaaaacctcatcaatcacaaccatgggttcaacaggtgaaaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8642 - DNA, 332 bp, Artificial
  MsCOMT deletion introduced by TALEN pair MsCOMT_T01.1
tctcacaaaaacctcatcaatcacaaccatgggttcaacaggtgaaaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8643 - DNA, 332 bp, Artificial
  MsCOMT deletion introduced by TALEN pair MsCOMT_T01.1
tctcacaaaaacctcatcaatcacaaccatgggttcaacaggtgaaaagcaaacctcttcgccaggcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 8644 - DNA, 352 bp, Artificial
  MsCOMT deletion introduced by TALEN pair MsCOMT_T01.1
tctcacaaaaacctcatcaatcacaaccatgggttcaacaggtgaaaacccacctatcagattaagaagcaaacctcttcgccatgcaactagcaagtgcttcagttcttcccatgattttgaaatcagctattgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8645 - DNA, 352 bp, Artificial
  MsCOMT deletion introduced by TALEN pair MsCOMT_T01.1
tctcacaaaaacctcatcaatcacaaccatgggttcaacaggtgaaaacccacctatcagatgcagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8646 - DNA, 352 bp, Artificial
  MsCOMT deletion introduced by TALEN pair MsCOMT_T01.1
tctcacaaaaacctcatcaatcacaaccatgggttcaacaggtgaaaacccacctatcagatgaagaagcaaacctcttcgccatgcacttagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8647 - DNA, 352 bp, Artificial
  MsCOMT deletion introduced by TALEN pair MsCOMT_T01.1
tctcacaaaaacctcatcaatcacaaccatgggttcaacaggtgaaaacccacctatcagatgaagaagcaaacctcttcgccatgcacttagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8648 - DNA, 352 bp, Artificial
  MsCOMT deletion introduced by TALEN pair MsCOMT_T01.1
tctcacaaaaacctcatcaatcacaaccatgggttcaacaggtgaaaacccacctatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8649 - DNA, 352 bp, Artificial
  MsCOMT deletion introduced by TALEN pair MsCOMT_T01.1
tctcacaaaaacctcatcaatcacaaccatgggttcaacaggtgaaaacccacctatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8650 - DNA, 352 bp, Artificial
  MsCOMT deletion introduced by TALEN pair MsCOMT_T01.1
tctcacaaaaacctcatcaatcacaaccatgggttcaacaggtgaaaacccacctatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8651 - DNA, 352 bp, Artificial
  MsCOMT deletion introduced by TALEN pair MsCOMT_T01.1
tctcacaaaaacctcatcaatcacaaccatgggttcaacaggtgaaaacccacctatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgattcaccagttatgttggaccgaatgttgcgtctcttggcttgttacaatatcctcacttgttcagttcgtactcaacaagatggaaaggttcagagcctttatggtttggctactgttgctaa

SEQ ID NO: 8652 - DNA, 352 bp, Artificial
  MsCOMT deletion introduced by TALEN pair MsCOMT_T01.1
tctcacaaaaacctcatcaatcacaaccatgggttcaacaggtgaaaacccacctatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8653 - DNA, 352 bp, Artificial
  MsCOMT deletion introduced by TALEN pair MsCOMT_T01.1
tctcacaaaaacctcatcaatcacaaccatgggttcaacaggtgaaaacccacctatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8654 - DNA, 352 bp, Artificial
  MsCOMT deletion introduced by TALEN pair MsCOMT_T01.1
tctcacaaaaacctcatcaatcacaaccatgggttcaacaggtgaaaacccacctatcagatgaagaagcaaacctcttcgccatgcaattagcaagtgcttcagttattcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8655 - DNA, 352 bp, Artificial
  MsCOMT deletion introduced by TALEN pair MsCOMT_T01.1
tctcacaaaaacctcatcaatcacaaccatgggttcaacaggtgaaaacccacctatcagatgaagaagcaaacctcttcgccatgcaattagcaagtgcctcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8656 - DNA, 352 bp, Artificial
  MsCOMT deletion introduced by TALEN pair MsCOMT_T01.1
tctcacaaaaacctcatcaatcacaaccatgggttcaacaggtgaaaacccacctatcagatgaagaagcaaacctcttcgccatgcaactagcaagtgcttcagttcttcccatgattttgaaatcagctcttgaacttgatctcttagaaatcattgctaaagctggacctggtgctcagatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8657 - DNA, 352 bp, Artificial
  MsCOMT deletion introduced by TALEN pair MsCOMT_T01.1
tctcacaaaaacctcatcaatcacaaccatgggttcaacaggtgaaaacccacctatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 8658 - DNA, 352 bp, Artificial
  MsCOMT deletion introduced by TALEN pair MsCOMT_T01.1
tctcacaaaaacctcatcaatcacaaccatgggttcaacaggtgaaaacccacctatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 8659 - DNA, 352 bp, Artificial
  MsCOMT deletion introduced by TALEN pair MsCOMT_T01.1
tctcacaaaaacctcatcaatcacaaccatgggttcaacaggtgaaaacccacctatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8660 - DNA, 352 bp, Artificial
  MsCOMT deletion introduced by TALEN pair MsCOMT_T01.1
tctcacaaaaacctcatcaatcacaaccatgggttcaacaggtgaaaacccacctatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8661 - DNA, 352 bp, Artificial
  MsCOMT deletion introduced by TALEN pair MsCOMT_T01.1
tctcacaaaaacctcatcaatcacaaccatgggttcaacaggtgaaaacccacctatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8662 - DNA, 352 bp, Artificial
  MsCOMT deletion introduced by TALEN pair MsCOMT_T01.1
tctcacaaaaacctcatcaatcacaaccatgggttcaacaggtgaaaacccacctatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8663 - DNA, 352 bp, Artificial
  MsCOMT deletion introduced by TALEN pair MsCOMT_T01.1
tctcacaaaaacctcatcaatcacaaccatgggttcaacaggtgaaaacccacctatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttattacaatatcctcacttgttcagttcgtactcaacaagatggaaaggttcagagactttatggtttggctactgttgctaa

SEQ ID NO: 8664 - DNA, 351 bp, Artificial
  MsCOMT deletion introduced by TALEN pair MsCOMT_T01.1
tctcacaaaaacctcatcaatcacaaccatgggttcaacaggtgaaaacccacatatcggatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 8665 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagattaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8666 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagattaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8667 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgcagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8668 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctctttgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 8669 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgtcatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8670 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcagctagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8671 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcacttagcaagtgcttcagttcttcccatgattttgaaatcagctcttgaacttggtctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8672 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcacttagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggatcgaatgttgcgtctcttggcttgttacaatatcctcacttgttcagttcgtactcaacaagatggaaaggttcagagactttatggtttggctactgttgctaa

SEQ ID NO: 8673 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcacttagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8674 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcacctagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 8675 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcacctagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 8676 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcacctagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8677 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcacctagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8678 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcacctagcaagagcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8679 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaattagcaagttcttcagttcttcccatgattttgaaatcagctcttgaacttgatctcttagaaatcattgctaaagctgggcctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8680 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaattagcaagttcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8681 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaattagcaagttcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 8682 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaattagcaagttcttcagttcttcccatgattttaaaatcagctcttgaacttgatctcttagaaatcattgctaaagctggacctggtgctcaaatttcacctattgaaattgcttctcagctcccgacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8683 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaattagcaagttcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8684 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaattagcaagttcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcatgttacaatatcctcacttgttcagttcgtactcaacaagatggaaagattcagagactttatggtttggctactgttgctaa

SEQ ID NO: 8685 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaattagcaagttcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8686 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8687 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8688 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgccgcccttggctttagacaattacatgactcgttctgttcgtactcaacaagatggaaaggttcagagtctgtctggattggggactgttactaa

SEQ ID NO: 8689 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8690 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8691 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 8692 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8693 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatacaccagttatgttggaccgaatgttgcgtctcttggcttgttacaatatcctcacttgttcagttcgtactcaacaagatggaaaagttcagagactttatggtttggctactgttgctaa

SEQ ID NO: 8694 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaattagcaagtgcttcagttcttcccatgattttcaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8695 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaattagcaagtgcttcagttcttcccatgattttaaaatcagctcttgatcttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8696 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaattagcaagtgcttcagttcttcccatgattttaaaatcagctcttgaacttgatctcttagagatcattgctaaagctggacctggtgctcaaatttcacctattgaaattgcttctcagctcccaacaactaaccctgatgcaccagttatgttggaccgaaagttgcgtctcttggcttgttacaatatcctcacttgttcagttcgtactcaacaagatggaaaggttcagagactttatggtttggctactgttgctaa

SEQ ID NO: 8697 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaattagcaagtgcttcagttcttcccatgattttaaaatcagctcttgaacttgatctcttagaaatctttgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8698 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaattagcaagtgcttcagttcttcccatgattttaaaatcagctcttgaacttgatctcttagaaatctttgctaaacctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8699 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaattagcaagtgcttcagttcttcccatgattttaaaatcagctcttgaacttgatctcttagaaatcattgctaaagctggacctggtgttcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8700 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8701 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 8702 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 8703 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 8704 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 8705 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8706 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 8707 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 8708 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8709 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8710 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttacgtctcttggcttgttacaatatcctcacttgttcagttcgtactcaacaagatggaaagattcagagactttatggtttggctactgttgctaa

SEQ ID NO: 8711 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcgacaagatggaaaggttcagagactttatggtttggctactgttgctaa

SEQ ID NO: 8712 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8713 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcatactcaacaagatggaaaggttcagagactttatggtttggctactgttgctaa

SEQ ID NO: 8714 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 8715 - DNA, 351 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgcaa

SEQ ID NO: 8716 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 8717 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8718 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgtcgcgtctcttggcttgttacaatatcctcacttgttcagttcgtactcaacaagatggaaaggttcagagactttatggtttggctactgttgctaa

SEQ ID NO: 8719 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8720 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8721 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagttggaaagattcagagactttatggtttggctactgttgctaa

SEQ ID NO: 8722 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 8723 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 8724 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatgtcacctattgaaattgcttctcagatcccaacaactaaccctgattcaccagttatgttggaccgaatgttgcgtatctatgctaattaaaatatcatgtattgttcagttcgtactcatcaatatggaaaggttcagagactttagggtttggctaatgttcctaa

SEQ ID NO: 8725 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaattagcaagtgcttcagttcttcccatgattttaaaatcagctcttgaacttgatctcttagaaatcattgctaaagctggacctggtgcccaaatttcacctaatgaaattgcttctcagctcccaacaattaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8726 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaattagcaagtgcttcagttcttcccatgattttaaaatcagctcttgaacttgatctcttagaaatcattcctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8727 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaattagcaagtgcttcagttcttcccatgattttaaaatcagctcttgaacttaatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatgttttggctactgttgctaa

SEQ ID NO: 8728 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaattagcaagtgcttcagttcttcccatgattttaaaatcagctcttgaacctgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8729 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaattagcaagtgcttcagttcttcccatgattttaaaatcagctctggaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8730 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaattagcaagagcttcagttcttcccatgattttaaaatcagctcttgaacttgatctcttagaaatcattgctaaagctggacctggtgctcaaatttcgcctattgaaattgcttctcagctcccaacaactaaccctgatgcaccagttatgttggaccgaatgttgcgtctcttggcttgttacaacatcctcacttgttcagttcgtactcaacaagatggaaagtttcagaggctttatggtttggcgactggtgctaa

SEQ ID NO: 8731 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaattagaaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8732 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaactagcaagttcttcagttcttcccatgattttgaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8733 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaactagcaagttcttcagttcttcccatgattttgaaatcagctcttgaacttgatctcttagaaatcattgctaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaagttcagagcctttatggtttggctactgttgctaa

SEQ ID NO: 8734 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaactagcaagttcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 8735 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaactagcaagttcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8736 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaactagcaagttcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 8737 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaactagcaagttcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8738 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaactagcaagttcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8739 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaactagcaagttcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8740 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaactagcaagttcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggctcagagactttatggtttggctactgttgttaa

SEQ ID NO: 8741 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaactagcaagttcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgtggcgtctcttggcttgttacaatatcctcacttgttcagttcgtactcaacaagatggaaaggttcagagcctttatggtttggctactgttgctaa

SEQ ID NO: 8742 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaactagcaagtgcttcagttcttcgcatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8743 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaactagcaagtgcttcagttcttcccatgattttgaaatcagctcttgaacttgatctcttagaaatcattgctaaagctgtacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8744 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcgcctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8745 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8746 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgtaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8747 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcggctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8748 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8749 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8750 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8751 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 8752 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcatggcttgttacaatatcctcacttgttcagttcgtactcaacaagatggaaagattcagagactttatggtttggctactgttgctaa

SEQ ID NO: 8753 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8754 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 8755 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8756 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8757 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8758 - DNA, 350 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttagggtttggctactgttgaa

SEQ ID NO: 8759 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcggttcgtactcaacaagatggaaaggttcagagactttatggtttggctactgttgctaa

SEQ ID NO: 8760 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 8761 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 8762 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcaactattgaaattgcttctcagctaccaacgactagctctgatgcaccagttatgttggaccgaatgttgcgtctcttggcttgttacaatatcctcacttgttcagttcgtactcaacaagatggaaaggttcagagactttattgtttggctactgttgctaa

SEQ ID NO: 8763 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatgtcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8764 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaactagcaagtgcttcagttcttcccatgattttgaaatcagctcatgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8765 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggcaaggttcagagactttatggtttggctactgttgctaa

SEQ ID NO: 8766 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 8767 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8768 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8769 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8770 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcggttcgtactcaacaagatggaaagattcagagactttatggtttggctactgttgctaa

SEQ ID NO: 8771 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggctggttacaatatcctcacttgttcagttcgtactcaacaagatggaaaggttcagagactttatggtttggctactgttgctaa

SEQ ID NO: 8772 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8773 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8774 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcctctcagctaccaacaactaaccctgatgcaccagttatgttggaccgaaagtagcgtctcttggcttgaaacaatatcctcacttgttcagttcgtactcaacaagatggaaaggttcagagactttatggtttggctactgttgctaa

SEQ ID NO: 8775 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaacctctacgccaagcaactagcaagagcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8776 - DNA, 352 bp, Artificial
  MsCOMT deletion introduced by TALEN pair MsCOMT_T01.1
tctcacaaaaacctcatcaatcacaaccatgggttcaacaggtgaaaacccacatatcagatgaagaagcaaaccccttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8777 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcggatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagtccgtactcaacaagatggaaagattcagagactttatggtttggctactgttgctaa

SEQ ID NO: 8778 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagattaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8779 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagattaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtcgcttggcttgttacaatatcctcacttgttcagttcgtactcaacaagatggaaaggttcagagactttatggtttggctactgttgctaa

SEQ ID NO: 8780 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagattaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 8781 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagattaagaagcaaacctcttcgccatgcaactagcaattgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8782 - DNA, 352 bp, Artificial
  MsCOMT deletion introduced by TALEN pair MsCOMT_T01.1
tctcacaaaaacctcatcaatcacaaccatgggttcaacaggtgaaaaacccacatatcagattaagaagcaaacctcttcgccatgcaactagcaattgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggacagaatgtcgcgtctcttggcttgttacaatatcctcacttgttcagttcgtactcaacaagatggaaaggttcagagactttatggtttgctactgttgctaa

SEQ ID NO: 8783 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagattaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8784 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagattaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8785 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgccattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8786 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgccattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8787 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgccattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaattgtgcgtctcttggcttgttacaatatcctcacttgttcagttcgtactcaacaagatggaaaggttcagagactttatggtttggctactgttgctaa

SEQ ID NO: 8788 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgccactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8789 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgccactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8790 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcacttagcaagtgcttcagttcttcccatgattttaaaatcagctcttgaacttgatctcttagaaatcattgctaaagctggacctggtgctctaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8791 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcacttagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcatctcttggcttgttacaatatcctcacttgttcagttcgtactcaacaagatggaaagattcagagactttatggtttggctactgttgctaa

SEQ ID NO: 8792 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaattagcaattgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8793 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaattagcaattgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8794 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaattagcaattgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8795 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaattagcaattgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8796 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaattagcaattgcttcagttcttcccatgattttaaaatcagctcctgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 8797 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaattagcaagtgcttcagttcttctcatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8798 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattggttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8799 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8800 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8801 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaattagcaagtgcttcagttcttcccatgattttaaaatcagctcttgaacttgatgtcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8802 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8803 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 8804 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttaccatatcctcacttgttcagttcgtactcaacaagatggaaaggttcagagactttatggtttggctactgttgctaa

SEQ ID NO: 8805 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 8806 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 8807 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8808 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8809 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8810 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 8811 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttgtaccgaatgttgcgtctctgggcttgttacaatatcctcacttgttcagttcgtactcaacaagatggaaagattcagagtctttatggtttggctactggtgctaa

SEQ ID NO: 8812 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8813 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8814 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8815 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcatcacttgttcagttcgtactcaacaagatggaaaagttcagagactttatggtttggctactgttgctaa

SEQ ID NO: 8816 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaaccagatggaaaggttcagagactttatggtttggctactgttgctaa

SEQ ID NO: 8817 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8818 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8819 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8820 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaattagcaagtgcttcagttcttcccatgattttaaaatcagctcttgaacttgatctcttagaaatcattgctaaagctggacctggagctcaaatttcacctattgaaattgcttctcaactaccaacacctaaccctgatgcacccgttatgttggaccgaatgttgcgtccctttgcttgttacaatatcctctcttgttcagttcgtactcaacaagatggaaaagatcagagactttatggtttggcgactgttgctaa

SEQ ID NO: 8821 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaattagcaagtgcttcagttcttcccatgattttaaaatcagctcttgaacttgatctcttagaaatcattgctaaagctggacccggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8822 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaattagcaagtgcttcagttcttcccatgattttaaaatcagctctcgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8823 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaactagcaattgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8824 - DNA, 352 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaactagcaattgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctatgttgctaa

SEQ ID NO: 8825 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaactagcaattgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8826 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaactagcaattgcttcagttcttcccatgattttaaaatcagctcttgaacttgatctcttagaaatcattgctaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8827 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaactagcaagtgcttcagttcttcccatgattttgaaatcagctcttgaactttatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8828 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 8829 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 8830 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8831 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8832 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8833 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 8834 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8835 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8836 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttgacttgttacaatatcctcacttgttcagttcgtactcaacaagatggaaagattcagagactttatggtttggctactgttgctaa

SEQ ID NO: 8837 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttctgagactttatggtttggctactgttgctaa

SEQ ID NO: 8838 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8839 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 8840 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggttactgttgctaa

SEQ ID NO: 8841 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctatcgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8842 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaactagcaagtgcttcagttcttcccatgattttgaaatcagctcttgaacttgatctcttagaaatcattgctaaagctggacctggtactcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8843 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8844 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8845 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8846 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaggatggaaagattcagagactttatggtttggctactgttgctaa

SEQ ID NO: 8847 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8848 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8849 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 8850 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaactagcaagtgcttcagttcttcccatgattttaaaatcagctcttgaacttgatctcttagaaatcattgctaaagctggacctggtactcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 8851 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccatgcaactagcaagtgcttcagttcttcccatgattttaaaatcagctcttgaacttgatctcttagaaatcattgataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8852 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagatgaagaagcaaacctcttcgccacgcaattagcaagtgcttcagttcttcccatgattttaaaatcagctcttgaacttgatctcttagaaatcattgctaaagctgggcctggtgctcaaatttcacctattgaaattgcttctcagctaccaacatctaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8853 - DNA, 353 bp, Artificial
  MsCOMT deletion introduced by TALEN pair MsCOMT_T01.1
tctcacaaaaacctcatcaatcacaaccatgggttcaacaggtgaaaaacccacatatcagaggaagaagcaaacctcttcgccatgcaattagcaatagcttcagttcttcccatgattttaaaatcagctcttgaacttgatctcttataaatcattgctaaagcttgacctggtgctcaaatttcacctattgaaattgcttctcagctaccaacaactaaccctgatgcaccagttatgttggaccgaatgttgcatctcttggcttgttacaatatcctcacttgttcagttcgtacccaacaagatggaaaggttcagagactttatggtttggctactgttgctaa

SEQ ID NO: 8854 - DNA, 348 bp, Artificial
  MsCOMT deletion introduced by TALEN pair MsCOMT_T01.1
tctcacaaaaacctcatcaatcacaaccatgggttcaacaggtacccacctatcagattaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8855 - DNA, 348 bp, Artificial
  MsCOMT deletion introduced by TALEN pair MsCOMT_T01.1
tctcacaaaaacctcatcaatcacaaccatgggttcaacaggtacccacctatcagattaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8856 - DNA, 348 bp, Artificial
  MsCOMT deletion introduced by TALEN pair MsCOMT_T01.1
tctcacaaaaacctcatcaatcacaaccatgggttcaacaggtacccacctatcagatgaagaagccaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaatgattcagagactttatggtttggctactgttgctaa

SEQ ID NO: 8857 - DNA, 348 bp, Artificial
  MsCOMT deletion introduced by TALEN pair MsCOMT_T01.1
tctcacaaaaacctcatcaatcacaaccatgggttcaacaggtacccacctatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 8858 - DNA, 348 bp, Artificial
  MsCOMT deletion introduced by TALEN pair MsCOMT_T01.1
tctcacaaaaacctcatcaatcacaaccatgggttcaacaggtacccacctatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8859 - DNA, 348 bp, Artificial
  MsCOMT deletion introduced by TALEN pair MsCOMT_T01.1
tctcacaaaaacctcatcaatcacaaccatgggttcaacaggtacccacctatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcatctcttggcttgttacaatatcctcacttgttctgttcgtacccaacaagatggaaagattcagagactttatggtttggctactgttgctaa

SEQ ID NO: 8860 - DNA, 348 bp, Artificial
  MsCOMT deletion introduced by TALEN pair MsCOMT_T01.1
tctcacaaaaacctcatcaatcacaaccatgggttcaacaggtacccacctatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8861 - DNA, 348 bp, Artificial
  MsCOMT deletion introduced by TALEN pair MsCOMT_T01.1
tctcacaaaaacctcatcaatcacaaccatgggttcaacaggtacccacctatcagatcaagacgcaaacctcttcgccatgcaattaccaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 8862 - DNA, 348 bp, Artificial
  MsCOMT deletion introduced by TALEN pair MsCOMT_T01.1
tctcacaaaaacctcatcaatcacaaccatgggttcaacaggtacccacctatcagatcaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8863 - DNA, 348 bp, Artificial
  MsCOMT deletion introduced by TALEN pair MsCOMT_T01.1
tctcacaaaaacctcatcaatcacaaccatgggttcaacaggtacccacatatcatatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8864 - DNA, 348 bp, Artificial
  MsCOMT deletion introduced by TALEN pair MsCOMT_T01.1
tctcacaaaaacctcatcaatcacaaccatgggttcaacaggtacccacatatcagattaagaagcaaacctcttcgccatgcaattagcaagtgcttcagttcttcccatgattttgaaatcagctcttgaacttgatctcttagaaatcattgctaaggctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8865 - DNA, 348 bp, Artificial
  MsCOMT deletion introduced by TALEN pair MsCOMT_T01.1
tctcacaaaaacctcatcaatcacaaccatgggttcaacaggtacccacatatcagattaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 8866 - DNA, 348 bp, Artificial
  MsCOMT deletion introduced by TALEN pair MsCOMT_T01.1
tctcacaaaaacctcatcaatcacaaccatgggttcaacaggtacccacatatcagattaagaagcaaacctcttcgccatgcaattagcaagtgcttcagttcttcccatgattttgaaatcagctcttgaacttgatctcttagaaatcattgctaaagctggacctggtgctcaaattccacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8867 - DNA, 348 bp, Artificial
  MsCOMT deletion introduced by TALEN pair MsCOMT_T01.1
tctcacaaaaacctcatcaatcacaaccatgggttcaacaggtacccacatatcagattaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggttactgttgctaa

SEQ ID NO: 8868 - DNA, 348 bp, Artificial
  MsCOMT deletion introduced by TALEN pair MsCOMT_T01.1
tctcacaaaaacctcatcaatcacaaccatgggttcaacaggtacccacatatcagattaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 8869 - DNA, 348 bp, Artificial
  MsCOMT deletion introduced by TALEN pair MsCOMT_T01.1
tctcacaaaaacctcatcaatcacaaccatgggttcaacaggtacccacatatcagattaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 8870 - DNA, 348 bp, Artificial
  MsCOMT deletion introduced by TALEN pair MsCOMT_T01.1
tctcacaaaaacctcatcaatcacaaccatgggttcaacaggtacccacatatcagattaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttagcttgttacaatatcctcacttgttcagttcgtactcaacaagatggaaagattcagagactttatggtttggctactgttgctaa

SEQ ID NO: 8871 - DNA, 348 bp, Artificial
  MsCOMT deletion introduced by TALEN pair MsCOMT_T01.1
tctcacaaaaacctcatcaatcacaaccatgggttcaacaggtacccacatatcagattaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8872 - DNA, 348 bp, Artificial
  MsCOMT deletion introduced by TALEN pair MsCOMT_T01.1
tctcacaaaaacctcatcaatcacaaccatgggttcaacaggtacccacatatcagattaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8873 - DNA, 348 bp, Artificial
  MsCOMT deletion introduced by TALEN pair MsCOMT_T01.1
tctcacaaaaacctcatcaatcacaaccatgggttcaacaggtacccacatatcagattaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8874 - DNA, 348 bp, Artificial
  MsCOMT deletion introduced by TALEN pair MsCOMT_T01.1
tctcacaaaaacctcatcaatcacaaccatgggttcaacaggtacccacatatcagattaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8875 - DNA, 348 bp, Artificial
  MsCOMT deletion introduced by TALEN pair MsCOMT_T01.1
tctcacaaaaacctcatcaatcacaaccatgggttcaacaggtacccacatatcagattaagaagcaaacctcttcgccatgcaattagcaagtgcttcagttcttcccatgattttaaaatcagctcttgaacttgatctcttagaaatcattgctaaagctggacctggggctcaaatttcacctattgaaattgcttctcagctcccaacaactaaccctgatgcaccagttatgttggaccgaatgttgcgtctcttggcttgttacaatatcctcactttttcagttcgtactcaacaagatggaaagcttccgcgcctttatggtttggctactgttgctaa

SEQ ID NO: 8876 - DNA, 348 bp, Artificial
  MsCOMT deletion introduced by TALEN pair MsCOMT_T01.1
tctcacaaaaacctcatcaatcacaaccatgggttcaacaggtacccacatatcagattaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8877 - DNA, 348 bp, Artificial
  MsCOMT deletion introduced by TALEN pair MsCOMT_T01.1
tctcacaaaaacctcatcaatcacaaccatgggttcaacaggtacccacatatcagatgaataagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8878 - DNA, 348 bp, Artificial
  MsCOMT deletion introduced by TALEN pair MsCOMT_T01.1
tctcacaaaaacctcatcaatcacaaccatgggttcaacaggtacccacatatcagatgaagaatcaaacctcttcgccattcaattagcaagttcttcagttcttcccatgatttgaaaatcagctcttgaacttgatctctgagaaatcattgctaaagctggacctggtgctcaaatttctcctattgaaattgcttctcagctaccaacaactaaccctgatgcaccagttatgttggaccgaatgttgcgtctcgtggcttgttagaatatcctcacttgttctgttcgtactcaacaagatggaaaggttcagagactttatggtttggctactgttgctaa

SEQ ID NO: 8879 - DNA, 348 bp, Artificial
  MsCOMT deletion introduced by TALEN pair MsCOMT_T01.1
tctcacaaaaacctcatcaatcacaaccatgggttcaacaggtacccacatatcagatgaagaagcaaacctcttcgccatgtaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8880 - DNA, 348 bp, Artificial
  MsCOMT deletion introduced by TALEN pair MsCOMT_T01.1
tctcacaaaaacctcatcaatcacaaccatgggttcaacaggtacccacatatcagatgaagaagcaaacctcttcgccatgtaattagcaagtgcttcagttcttcccatgattctaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8881 - DNA, 348 bp, Artificial
  MsCOMT deletion introduced by TALEN pair MsCOMT_T01.1
tctcacaaaaacctcatcaatcacaaccatgggttcaacaggtacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8882 - DNA, 348 bp, Artificial
  MsCOMT deletion introduced by TALEN pair MsCOMT_T01.1
tctcacaaaaacctcatcaatcacaaccatgggttcaacaggtacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaagttcagagactttatggtttggctactgttgctaa

SEQ ID NO: 8883 - DNA, 348 bp, Artificial
  MsCOMT deletion introduced by TALEN pair MsCOMT_T01.1
tctcacaaaaacctcatcaatcacaaccatgggttcaacaggtacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8884 - DNA, 348 bp, Artificial
  MsCOMT deletion introduced by TALEN pair MsCOMT_T01.1
tctcacaaaaacctcatcaatcacaaccatgggttcaacaggtacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8885 - DNA, 348 bp, Artificial
  MsCOMT deletion introduced by TALEN pair MsCOMT_T01.1
tctcacaaaaacctcatcaatcacaaccatgggttcaacaggtacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 8886 - DNA, 348 bp, Artificial
  MsCOMT deletion introduced by TALEN pair MsCOMT_T01.1
tctcacaaaaacctcatcaatcacaaccatgggttcaacaggtacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8887 - DNA, 348 bp, Artificial
  MsCOMT deletion introduced by TALEN pair MsCOMT_T01.1
tctcacaaaaacctcatcaatcacaaccatgggttcaacaggtacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagcctttatggttgggctactgttgctaa

SEQ ID NO: 8888 - DNA, 348 bp, Artificial
  MsCOMT deletion introduced by TALEN pair MsCOMT_T01.1
tctcacaaaaacctcatcaatcacaaccatgggttcaacaggtacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8889 - DNA, 348 bp, Artificial
  MsCOMT deletion introduced by TALEN pair MsCOMT_T01.1
tctcacaaaaacctcatcaatcacaaccatgggttcaacaggtacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8890 - DNA, 348 bp, Artificial
  MsCOMT deletion introduced by TALEN pair MsCOMT_T01.1
tctcacaaaaacctcatcaatcacaaccatgggttcaacaggtacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttgcaatatcctcacttgttcagttcgtactcaacaagatggaaaggttcagagactttatggtttggctactgttgctaa

SEQ ID NO: 8891 - DNA, 348 bp, Artificial
  MsCOMT deletion introduced by TALEN pair MsCOMT_T01.1
tctcacaaaaacctcatcaatcacaaccatgggttcaacaggtacccacatatcagatgaagaagcaaacctcttcgccatgcaattagcaagtgcttcagttcttcccatgattttgaaatcagctcttgaacttgatctcttagaaatcattgctaaagctggacctggtgctcaaatttaacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8892 - DNA, 348 bp, Artificial
  MsCOMT deletion introduced by TALEN pair MsCOMT_T01.1
tctcacaaaaacctcatcaatcacaaccatgggttcaacaggtacccacatatcagatgaagaagcaaacctcttcgccatgcaattagcaagtgcttcagttcttcccatgattttgaaatcagctcttgaacttgatctcttagaaatcattgctaaagctggacccggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8893 - DNA, 348 bp, Artificial
  MsCOMT deletion introduced by TALEN pair MsCOMT_T01.1
tctcacaaaaacctcatcaatcacaaccatgggttcaacaggtacccacatatcagatgaagaagcaaacctcttcgccatgcaattagcaagtgcttcagttcttcccatgattttaaaatcagctcttgaacttgatctcttagaaatcattgctaaagctggacctgttgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8894 - DNA, 348 bp, Artificial
  MsCOMT deletion introduced by TALEN pair MsCOMT_T01.1
tctcacaaaaacctcatcaatcacaaccatgggttcaacaggtacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8895 - DNA, 348 bp, Artificial
  MsCOMT deletion introduced by TALEN pair MsCOMT_T01.1
tctcacaaaaacctcatcaatcacaaccatgggttcaacaggtacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 8896 - DNA, 348 bp, Artificial
  MsCOMT deletion introduced by TALEN pair MsCOMT_T01.1
tctcacaaaaacctcatcaatcacaaccatgggttcaacaggtacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 8897 - DNA, 348 bp, Artificial
  MsCOMT deletion introduced by TALEN pair MsCOMT_T01.1
tctcacaaaaacctcatcaatcacaaccatgggttcaacaggtacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 8898 - DNA, 348 bp, Artificial
  MsCOMT deletion introduced by TALEN pair MsCOMT_T01.1
tctcacaaaaacctcatcaatcacaaccatgggttcaacaggtacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 8899 - DNA, 347 bp, Artificial
  MsCOMT deletion introduced by TALEN pair MsCOMT_T01.1
tctcacaaaaacctcatcaatcacaaccatgggttcaacaggtacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgcta

SEQ ID NO: 8900 - DNA, 348 bp, Artificial
  MsCOMT deletion introduced by TALEN pair MsCOMT_T01.1
tctcacaaaaacctcatcaatcacaaccatgggttcaacaggtacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8901 - DNA, 348 bp, Artificial
  MsCOMT deletion introduced by TALEN pair MsCOMT_T01.1
tctcacaaaaacctcatcaatcacaaccatgggttcaacaggtacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 8902 - DNA, 348 bp, Artificial
  MsCOMT deletion introduced by TALEN pair MsCOMT_T01.1
tctcacaaaaacctcatcaatcacaaccatgggttcaacaggtacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgtgtctcttggcttgttacaatatcctcacttgttcagttcgtactcaacaagatggaaagattcagagactttatggtttggctactgttgctaa

SEQ ID NO: 8903 - DNA, 348 bp, Artificial
  MsCOMT deletion introduced by TALEN pair MsCOMT_T01.1
tctcacaaaaacctcatcaatcacaaccatgggttcaacaggtacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8904 - DNA, 348 bp, Artificial
  MsCOMT deletion introduced by TALEN pair MsCOMT_T01.1
tctcacaaaaacctcatcaatcacaaccatgggttcaacaggtacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8905 - DNA, 347 bp, Artificial
  MsCOMT deletion introduced by TALEN pair MsCOMT_T01.1
tctcacaaaaacctcatcaatcacaaccatgggttcaacaggtacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgcta

SEQ ID NO: 8906 - DNA, 348 bp, Artificial
  MsCOMT deletion introduced by TALEN pair MsCOMT_T01.1
tctcacaaaaacctcatcaatcacaaccatgggttcaacaggtacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttagggtttggctactgttgctaa

SEQ ID NO: 8907 - DNA, 348 bp, Artificial
  MsCOMT deletion introduced by TALEN pair MsCOMT_T01.1
tctcacaaaaacctcatcaatcacaaccatgggttcaacaggtacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8908 - DNA, 348 bp, Artificial
  MsCOMT deletion introduced by TALEN pair MsCOMT_T01.1
tctcacaaaaacctcatcaatcacaaccatgggttcaacaggtacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 8909 - DNA, 349 bp, Artificial
  MsCOMT deletion introduced by TALEN pair MsCOMT_T01.1
tctcacaaaaacctcatcaatcacaaccatgggttcaacaggtacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgtttgctaa

SEQ ID NO: 8910 - DNA, 348 bp, Artificial
  MsCOMT deletion introduced by TALEN pair MsCOMT_T01.1
tctcacaaaaacctcatcaatcacaaccatgggttcaacaggtacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactattgctaa

SEQ ID NO: 8911 - DNA, 348 bp, Artificial
  MsCOMT deletion introduced by TALEN pair MsCOMT_T01.1
tctcacaaaaacctcatcaatcacaaccatgggttcaacaggtacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgaaccagttatgttggaccgaatgttgcgtctcttggcttgttacaatatcctcacttgttcagttcgtactcaacaagatggaaaagttcagagactttatggtttggctactgttgctaa

SEQ ID NO: 8912 - DNA, 348 bp, Artificial
  MsCOMT deletion introduced by TALEN pair MsCOMT_T01.1
tctcacaaaaacctcatcaatcacaaccatgggttcaacaggtacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggatcgaatgttgcgtctcttggcttgttacaatatcctcacttgttcagttcgtactcaacaagatggaaaggttcagagactttatggtttggctactgttgctaa

SEQ ID NO: 8913 - DNA, 348 bp, Artificial
  MsCOMT deletion introduced by TALEN pair MsCOMT_T01.1
tctcacaaaaacctcatcaatcacaaccatgggttcaacaggtacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8914 - DNA, 348 bp, Artificial
  MsCOMT deletion introduced by TALEN pair MsCOMT_T01.1
tctcacaaaaacctcatcaatcacaaccatgggttcaacaggtacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8915 - DNA, 348 bp, Artificial
  MsCOMT deletion introduced by TALEN pair MsCOMT_T01.1
tctcacaaaaacctcatcaatcacaaccatgggttcaacaggtacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8916 - DNA, 348 bp, Artificial
  MsCOMT deletion introduced by TALEN pair MsCOMT_T01.1
tctcacaaaaacctcatcaatcacaaccatgggttcaacaggtacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 8917 - DNA, 348 bp, Artificial
  MsCOMT deletion introduced by TALEN pair MsCOMT_T01.1
tctcacaaaaacctcatcaatcacaaccatgggttcaacaggtacccacatatcagatgaagaagcaaacctcttcgccatgcaattagcaagtgcttcagttcttcccatgattttaaaatcagctcttgaacttgatctcttagaaatcattgctaaagctggacctggtgctcaaattacacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8918 - DNA, 348 bp, Artificial
  MsCOMT deletion introduced by TALEN pair MsCOMT_T01.1
tctcacaaaaacctcatcaatcacaaccatgggttcaacaggtacccacatatcagatgaagaagcaaacctcttcgccatgcaattagcaagtgcttcagttcttcccatgattttaaaatcagctcttgaacttgatctcttagaaatcattgctaaagatggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8919 - DNA, 348 bp, Artificial
  MsCOMT deletion introduced by TALEN pair MsCOMT_T01.1
tctcacaaaaacctcatcaatcacaaccatgggttcaacaggtacccacatatcagatgaagaagcaaacctcttcgccatgcaattagcaagtgcttcagttcttccaatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8920 - DNA, 348 bp, Artificial
  MsCOMT deletion introduced by TALEN pair MsCOMT_T01.1
tctcacaaaaacctcatcaatcacaaccatgggttcaacaggtacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 8921 - DNA, 348 bp, Artificial
  MsCOMT deletion introduced by TALEN pair MsCOMT_T01.1
tctcacaaaaacctcatcaatcacaaccatgggttcaacaggtacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 8922 - DNA, 348 bp, Artificial
  MsCOMT deletion introduced by TALEN pair MsCOMT_T01.1
tctcacaaaaacctcatcaatcacaaccatgggttcaacaggtacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8923 - DNA, 348 bp, Artificial
  MsCOMT deletion introduced by TALEN pair MsCOMT_T01.1
tctcacaaaaacctcatcaatcacaaccatgggttcaacaggtacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 8924 - DNA, 348 bp, Artificial
  MsCOMT deletion introduced by TALEN pair MsCOMT_T01.1
tctcacaaaaacctcatcaatcacaaccatgggttcaacaggtacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8925 - DNA, 348 bp, Artificial
  MsCOMT deletion introduced by TALEN pair MsCOMT_T01.1
tctcacaaaaacctcatcaatcacaaccatgggttcaacaggtacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8926 - DNA, 348 bp, Artificial
  MsCOMT deletion introduced by TALEN pair MsCOMT_T01.1
tctcacaaaaacctcatcaatcacaaccatgggttcaacaggtacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8927 - DNA, 348 bp, Artificial
  MsCOMT deletion introduced by TALEN pair MsCOMT_T01.1
tctcacaaaaacctcatcaatcacaaccatgggttcaacaggtacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 8928 - DNA, 348 bp, Artificial
  MsCOMT deletion introduced by TALEN pair MsCOMT_T01.1
tctcacaaaaacctcatcaatcacaaccatgggttcaacaggtacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8929 - DNA, 348 bp, Artificial
  MsCOMT deletion introduced by TALEN pair MsCOMT_T01.1
tctcacaaaaacctcatcaatcacaaccatgggttcaacaggtacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8930 - DNA, 348 bp, Artificial
  MsCOMT deletion introduced by TALEN pair MsCOMT_T01.1
tctcacaaaaacctcatcaatcacaaccatgggttcaacaggtacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8931 - DNA, 348 bp, Artificial
  MsCOMT deletion introduced by TALEN pair MsCOMT_T01.1
tctcacaaaaacctcatcaatcacaaccatgggttcaacaggtacccacatatcagatgaagaagcaaacctcttcgccatgcaactaacaagtgcttcagttcttcccatgattttaaaatcagctcttgaactcgatctcttagaaatcattgctaaagctggacctggtgctcaaatttcacctattgaaattgcttctcagctcccaacaactaaccctgatgtaccagttatgttggaccgaatgttgcgtctcttggcttgttacaatatcctcacttgttcagttcgtactcaacaagatggaaaagttcagagactttatggtttggctactgttgctaa

SEQ ID NO: 8932 - DNA, 348 bp, Artificial
  MsCOMT deletion introduced by TALEN pair MsCOMT_T01.1
tctcacaaaaacctcatcaatcacaaccatgggttcaacaggtacccacatatcagatccaaaagcaaacctcttcgccatgcaaatagcaagcgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8933 - DNA, 345 bp, Artificial
  MsCOMT deletion introduced by TALEN pair MsCOMT_T01.1
tctcacaaaaacctcatcaatcacaaccatgggttcaacaggtaaaactcaagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8934 - DNA, 352 bp, Artificial
  MsCOMT deletion introduced by TALEN pair MsCOMT_T01.1
tctcacaaaaacctcatcaatcacaaccatgggttcaacaggtaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8935 - DNA, 349 bp, Artificial
  MsCOMT deletion introduced by TALEN pair MsCOMT_T01.1
tctcacaaaaacctcatcaatcacaaccatgggttcaacaggggacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 8936 - DNA, 349 bp, Artificial
  MsCOMT deletion introduced by TALEN pair MsCOMT_T01.1
tctcacaaaaacctcatcaatcacaaccatgggttcaacaggggaaactcatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 8937 - DNA, 350 bp, Artificial
  MsCOMT deletion introduced by TALEN pair MsCOMT_T01.1
tctcacaaaaacctcatcaatcacaaccatgggttcaacaggggaaactcaatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 8938 - DNA, 358 bp, Artificial
  MsCOMT deletion introduced by TALEN pair MsCOMT_T01.1
tctcacaaaaacctcatcaatcacaaccatgggttcaacaggggaaactcaagacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8939 - DNA, 356 bp, Artificial
  MsCOMT deletion introduced by TALEN pair MsCOMT_T01.1
tctcacaaaaacctcatcaatcacaaccatgggttcaacaggggaaactcaacccacatatcatatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaaccagatggaaagattcagagactttatggtttggctactgttgctaa

SEQ ID NO: 8940 - DNA, 356 bp, Artificial
  MsCOMT deletion introduced by TALEN pair MsCOMT_T01.1
tctcacaaaaacctcatcaatcacaaccatgggttcaacaggggaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8941 - DNA, 361 bp, Artificial
  MsCOMT deletion introduced by TALEN pair MsCOMT_T01.1
tctcacaaaaacctcatcaatcacaaccatgggttcaacaggggaaactcaaattaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8942 - DNA, 361 bp, Artificial
  MsCOMT deletion introduced by TALEN pair MsCOMT_T01.1
tctcacaaaaacctcatcaatcacaaccatgggttcaacaggggaaactcaaattaacccacatatcagatgaagaagcaaacctcttcgccatgcaactagcaagtgcttcagttcttcccattattttgaaatcagctcttgaacttgatctcttagaaatcattgctaaagctggaccttgtgctcaaatttcacctattgaaattgcttctcagctaccaacaactaaccctgatgcaccagttatgttggaccgaatgttgcgtctcttggcttgttacaatatcctcacttgttcagttcgtactcaacaagatggagaggttcagagactttatggtttggctactgttcctaa

SEQ ID NO: 8943 - DNA, 434 bp, Artificial
  MsCOMT deletion introduced by TALEN pair MsCOMT_T01.1
tctcacaaaaacctcatcaatcacaaccatgggttcaacaggggaaactcaaatggcacagcaccggcaacagcgcctgcaccgtctccagcgcctgcttgccaccaatattgctggcgatggccaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8944 - DNA, 359 bp, Artificial
  MsCOMT deletion introduced by TALEN pair MsCOMT_T01.1
tctcacaaaaacctcatcaatcacaaccatgggttcaacaggggaaactcaaatacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8945 - DNA, 359 bp, Artificial
  MsCOMT deletion introduced by TALEN pair MsCOMT_T01.1
tctcacaaaaacctcatcaatcacaaccatgggttcaacaggggaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8946 - DNA, 359 bp, Artificial
  MsCOMT deletion introduced by TALEN pair MsCOMT_T01.1
tctcacaaaaacctcatcaatcacaaccatgggttcaacaggggaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8947 - DNA, 359 bp, Artificial
  MsCOMT deletion introduced by TALEN pair MsCOMT_T01.1
tctcacaaaaacctcatcaatcacaaccatgggttcaacaggggaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgtttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8948 - DNA, 359 bp, Artificial
  MsCOMT deletion introduced by TALEN pair MsCOMT_T01.1
tctcacaaaaacctcatcaatcacaaccatgggttcaacaggggaaactcaaatacccacatatcagatgaagaagcaaacctcttcgccatacaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8949 - DNA, 357 bp, Artificial
  MsCOMT deletion introduced by TALEN pair MsCOMT_T01.1
tctcacaaaaacctcatcaatcacaaccatgggttcaacaggggaaactcaaataccacatatcagatgaagaagcaaacctcttcgccatgcaattagcaagtgcttcagttcttcccatgattttaaaatcagctcttgaacttggtctcttagaactcattgctaaagctgaacctggtgctcaaatttcacctattgaaattgcttctcagctcccaacaactaaccctgaggcaccagttatgttggaccgaatgttgcgtcgcttggctggtaacaatatcctcacttgttaagttcgtactcaacaagatggaaagattcagagactttatgttttggctcctgttctaa

SEQ ID NO: 8950 - DNA, 358 bp, Artificial
  MsCOMT deletion introduced by TALEN pair MsCOMT_T01.1
tctcacaaaaacctcatcaatcacaaccatgggttcaacaggggaaactcaaataccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 8951 - DNA, 363 bp, Artificial
  MsCOMT deletion introduced by TALEN pair MsCOMT_T01.1
tctcacaaaaacctcatcaatcacaaccatgggttcaacaggggaaactcaaataccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8952 - DNA, 363 bp, Artificial
  MsCOMT deletion introduced by TALEN pair MsCOMT_T01.1
tctcacaaaaacctcatcaatcacaaccatgggttcaacaggggaaactcaaataccaacccacatatcagatgaagaagcaaacctcttcgccatgcaattaacaagtgcttcagttcttcccatgattttaaaatcagctcttgaacttgatctcttagaaatcattgctaaagctggacctggcgctcaaatttcacctattgaaattgcttctcagctcccaacaactaaccctgatgcaccagttatgttggaccgaatgttacgtctcttggcttgttacaatatcctcacttgttcagttcgtactcaacaagatggaaaagttcagagactttatggtttggctactgttgctaa

SEQ ID NO: 8953 - DNA, 353 bp, Artificial
  MsCOMT deletion introduced by TALEN pair MsCOMT_T01.1
tctcacaaaaacctcatcaatcacaaccatgggttcaacaggggaaactcaaataactcagattaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8954 - DNA, 355 bp, Artificial
  MsCOMT deletion introduced by TALEN pair MsCOMT_T01.1
tctcacaaaaacctcatcaatcacaaccatgggttcaacaggggaaactcaaataactatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8955 - DNA, 360 bp, Artificial
  MsCOMT deletion introduced by TALEN pair MsCOMT_T01.1
tctcacaaaaacctcatcaatcacaaccatgggttcaacaggggaaactcaaataacccacatatcagctgaagaaccaaacctcttccccatgcaactagcaagggcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgtggcggcccgtggcttgtgacaatatccacacttgttcagttcgtactcaaccagatggaaaggttcggagacagtatggtttggcgactgatgctaa

SEQ ID NO: 8956 - DNA, 360 bp, Artificial
  MsCOMT deletion introduced by TALEN pair MsCOMT_T01.1
tctcacaaaaacctcatcaatcacaaccatgggttcaacaggggaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8957 - DNA, 360 bp, Artificial
  MsCOMT deletion introduced by TALEN pair MsCOMT_T01.1
tctcacaaaaacctcatcaatcacaaccatgggttcaacaggggaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8958 - DNA, 360 bp, Artificial
  MsCOMT deletion introduced by TALEN pair MsCOMT_T01.1
tctcacaaaaacctcatcaatcacaaccatgggttcaacaggggaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 8959 - DNA, 360 bp, Artificial
  MsCOMT deletion introduced by TALEN pair MsCOMT_T01.1
tctcacaaaaacctcatcaatcacaaccatgggttcaacaggggaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8960 - DNA, 360 bp, Artificial
  MsCOMT deletion introduced by TALEN pair MsCOMT_T01.1
tctcacaaaaacctcatcaatcacaaccatgggttcaacaggggaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8961 - DNA, 360 bp, Artificial
  MsCOMT deletion introduced by TALEN pair MsCOMT_T01.1
tctcacaaaaacctcatcaatcacaaccatgggttcaacaggggaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8962 - DNA, 360 bp, Artificial
  MsCOMT deletion introduced by TALEN pair MsCOMT_T01.1
tctcacaaaaacctcatcaatcacaaccatgggttcaacaggggaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8963 - DNA, 360 bp, Artificial
  MsCOMT deletion introduced by TALEN pair MsCOMT_T01.1
tctcacaaaaacctcatcaatcacaaccatgggttcaacaggggaaactcaaataacccacatatcagatgaagaagcaaacctcttcgccatgcaactagcaagtgcttcagttcttcccatgattttgaaatcagctcttgaacttgatctcttagcaatcattgctaacgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8964 - DNA, 360 bp, Artificial
  MsCOMT deletion introduced by TALEN pair MsCOMT_T01.1
tctcacaaaaacctcatcaatcacaaccatgggttcaacaggggaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8965 - DNA, 360 bp, Artificial
  MsCOMT deletion introduced by TALEN pair MsCOMT_T01.1
tctcacaaaaacctcatcaatcacaaccatgggttcaacaggggaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagcttcagagcctttatggtttggctactgttgctaa

SEQ ID NO: 8966 - DNA, 360 bp, Artificial
  MsCOMT deletion introduced by TALEN pair MsCOMT_T01.1
tctcacaaaaacctcatcaatcacaaccatgggttcaacaggggaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8967 - DNA, 360 bp, Artificial
  MsCOMT deletion introduced by TALEN pair MsCOMT_T01.1
tctcacaaaaacctcatcaatcacaaccatgggttcaacaggggaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8968 - DNA, 360 bp, Artificial
  MsCOMT deletion introduced by TALEN pair MsCOMT_T01.1
tctcacaaaaacctcatcaatcacaaccatgggttcaacaggggaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8969 - DNA, 360 bp, Artificial
  MsCOMT deletion introduced by TALEN pair MsCOMT_T01.1
tctcacaaaaacctcatcaatcacaaccatgggttcaacaggggaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgatacaatatcctcacttgttcagttcgtactcaacaagatggaaaagttcagagactttatggtttggctactgttgctaa

SEQ ID NO: 8970 - DNA, 360 bp, Artificial
  MsCOMT deletion introduced by TALEN pair MsCOMT_T01.1
tctcacaaaaacctcatcaatcacaaccatgggttcaacaggggaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8971 - DNA, 360 bp, Artificial
  MsCOMT deletion introduced by TALEN pair MsCOMT_T01.1
tctcacaaaaacctcatcaatcacaaccatgggttcaacaggggaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgtgcagttcgtactcaacaagatggaaaggttcagagactgtatggtttggctactgttgctaa

SEQ ID NO: 8972 - DNA, 360 bp, Artificial
  MsCOMT deletion introduced by TALEN pair MsCOMT_T01.1
tctcacaaaaacctcatcaatcacaaccatgggttcaacaggggaaactcaaataacccacatatcagatgaagaagcaaacctcttcgccatgcaactagcaagtgcttcagttcttcccatgattttgaaatcagctcttgaacttgatctcttagaaatcattgctaaagctggacctggggctcaaatttcccctattgaaattgcggctcagctaccaacaacgaacccggaggcaccagttatgggggaccgaaggttgcgtatattggattgttaaaatataatcacttgttcagttagtaatcaacaagatggaaaggttcagagcctttatggtttggcgactgtggctaa

SEQ ID NO: 8973 - DNA, 360 bp, Artificial
  MsCOMT deletion introduced by TALEN pair MsCOMT_T01.1
tctcacaaaaacctcatcaatcacaaccatgggttcaacaggggaaactcaaataacccacatatcagatgaagaagcaaacctcgtcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8974 - DNA, 360 bp, Artificial
  MsCOMT deletion introduced by TALEN pair MsCOMT_T01.1
tctcacaaaaacctcatcaatcacaaccatgggttcaacaggggaaactcaaataacccacatatcagatgaagaagcaaaactcatcgccatgcaactagcaagagcttcagttctacccatgattttgaaatcaacactagaacttgatctctcagaaatcattgctaaagctggacctggtgctcaaatttcacctattgaaattgcttctcagctaccaacaactaaccctgatgcaccagttatgttggaccgaattttgcgtctcttggcttgttacaatatcctcacttgttcagttcgtactcaacaagatggaaaggttcagagactttatggtttggctactgttgctaa

SEQ ID NO: 8975 - DNA, 364 bp, Artificial
  MsCOMT deletion introduced by TALEN pair MsCOMT_T01.1
tctcacaaaaacctcatcaatcacaaccatgggttcaacaggggaaactcaaataaccaacccacatatcagatgaagaagcaaacctcttcgccatgcaattagctagtgcttcagttcttcccatgattttaaaatcagctcttgaacttgatctcttagaaatcattgctaaagctgcacctggtgctcaaatttcaccttttgaaattgcttctcagctcccaacaactaaccctgatgcaccagttatgttggaccgaattttgcgtctcttggcttgttacaatatcctcacttgttcagttcgtactcaacaagatggaaagattcagagactttatggtttggctcctgttgctaa

SEQ ID NO: 8976 - DNA, 364 bp, Artificial
  MsCOMT deletion introduced by TALEN pair MsCOMT_T01.1
tctcacaaaaacctcatcaatcacaaccatgggttcaacaggggaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8977 - DNA, 364 bp, Artificial
  MsCOMT deletion introduced by TALEN pair MsCOMT_T01.1
tctcacaaaaacctcatcaatcacaaccatgggttcaacaggggaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctgatgctcaaatttcacctattgaaattggttctcagctaccaacaactaaccctgatgcaccagttatgttggaccgaatgttgcgtctcttggcttgttacaatatcctcacttgttcagttcgtactctacaagatggaaagattcagagaatttattgtttggttactgttgctaa

SEQ ID NO: 8978 - DNA, 353 bp, Artificial
  MsCOMT deletion introduced by TALEN pair MsCOMT_T01.1
tctcacaaaaacctcatcaatcacaaccatgggttcaacaggggaaactcaaataaatcagattaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8979 - DNA, 361 bp, Artificial
  MsCOMT deletion introduced by TALEN pair MsCOMT_T01.1
tctcacaaaaacctcatcaatcacaaccatgggttcaacaggggaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8980 - DNA, 361 bp, Artificial
  MsCOMT deletion introduced by TALEN pair MsCOMT_T01.1
tctcacaaaaacctcatcaatcacaaccatgggttcaacaggggaaactcaaataaacccacatatcagatgaagaagcaaacctcttcgccatgcaattagcaagagcttcagttcttcccatgattttaaaatcagctcttgaacttgatctcttagaaatcattgctaaagctggaccttgtgctcaaatttcacctattgaaattggttctcagctcccaacaactaaccctgatgcaccagttatgttgaaccgaattttgcgactcgtgagttgttacaatatcctcccttgttcagttagtaatcaacaagatggacagattcagagaatttatggtttcgctactgtagaaaa

SEQ ID NO: 8981 - DNA, 361 bp, Artificial
  MsCOMT deletion introduced by TALEN pair MsCOMT_T01.1
tctcacaaaaacctcatcaatcacaaccatgggttcaacaggggaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8982 - DNA, 361 bp, Artificial
  MsCOMT deletion introduced by TALEN pair MsCOMT_T01.1
tctcacaaaaacctcatcaatcacaaccatgggttcaacaggggaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 8983 - DNA, 362 bp, Artificial
  MsCOMT deletion introduced by TALEN pair MsCOMT_T01.1
tctcacaaaaacctcatcaatcacaaccatgggttcaacaggggaaactcaaataaaacccacatatcagatgaagaagcaaaccacttcgccatgcaactatcaagtgcttcagttcttcccatgattttgaaatcagctcttgaacttgatctcttagaaatgatggctaaagctgcacctgctgctcaaatttcacctattgaaattgcttctcagctaccaacaactaaccctgatgcaccagttatgttggaccgaatgttgcgtctcttggcttgttacaatatcctcacttgttcagttcgtactcaaccagatagaaaggttcagagactttatggtttggctactgttgctaa

SEQ ID NO: 8984 - DNA, 357 bp, Artificial
  MsCOMT deletion introduced by TALEN pair MsCOMT_T01.1
tctcacaaaaacctcatcaatcacaaccatgggttcaacaggggaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8985 - DNA, 357 bp, Artificial
  MsCOMT deletion introduced by TALEN pair MsCOMT_T01.1
tctcacaaaaacctcatcaatcacaaccatgggttcaacaggggaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 8986 - DNA, 357 bp, Artificial
  MsCOMT deletion introduced by TALEN pair MsCOMT_T01.1
tctcacaaaaacctcatcaatcacaaccatgggttcaacaggggaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8987 - DNA, 357 bp, Artificial
  MsCOMT deletion introduced by TALEN pair MsCOMT_T01.1
tctcacaaaaacctcatcaatcacaaccatgggttcaacaggggaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8988 - DNA, 357 bp, Artificial
  MsCOMT deletion introduced by TALEN pair MsCOMT_T01.1
tctcacaaaaacctcatcaatcacaaccatgggttcaacaggggaaactcaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8989 - DNA, 358 bp, Artificial
  MsCOMT deletion introduced by TALEN pair MsCOMT_T01.1
tctcacaaaaacctcatcaatcacaaccatgggttcaacaggggaaactcaaaacccacatatcagatgaagaagcaaacctcttcgccatgcaactagcaagtgcttcagttcttcccatgattttgaaatcagctcttgaacttgatctcttagaactcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaaccagatggaaaggttcagagactttatgggttcgctactgttgctaa

SEQ ID NO: 8990 - DNA, 358 bp, Artificial
  MsCOMT deletion introduced by TALEN pair MsCOMT_T01.1
tctcacaaaaacctcatcaatcacaaccatgggttcaacaggggaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8991 - DNA, 364 bp, Artificial
  MsCOMT deletion introduced by TALEN pair MsCOMT_T01.1
tctcacaaaaacctcatcaatcacaaccatgggttcaacaggggaaactaaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8992 - DNA, 351 bp, Artificial
  MsCOMT deletion introduced by TALEN pair MsCOMT_T01.1
tctcacaaaaacctcatcaatcacaaccatgggttcaacaggggaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8993 - DNA, 351 bp, Artificial
  MsCOMT deletion introduced by TALEN pair MsCOMT_T01.1
tctcacaaaaacctcatcaatcacaaccatgggttcaacaggggaaacccacatatcagaggaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtaatcaacaagatggaagggttcagagactttatggtttggctactgttgctaa

SEQ ID NO: 8994 - DNA, 361 bp, Artificial
  MsCOMT deletion introduced by TALEN pair MsCOMT_T01.1
tctcacaaaaacctcatcaatcacaaccatgggttcaacaggggaaacacaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8995 - DNA, 350 bp, Artificial
  MsCOMT deletion introduced by TALEN pair MsCOMT_T01.1
tctcacaaaaacctcatcaatcacaaccatgggttcaacaggcgaacccacatctcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8996 - DNA, 350 bp, Artificial
  MsCOMT deletion introduced by TALEN pair MsCOMT_T01.1
tctcacaaaaacctcatcaatcacaaccatgggttcaacaggcgaacccacatatcagatgaagaagcaaacctcttcgccatgcaactagcaagtgcttcagttcttcccatgattttgacatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8997 - DNA, 350 bp, Artificial
  MsCOMT deletion introduced by TALEN pair MsCOMT_T01.1
tctcacaaaaacctcatcaatcacaaccatgggttcaacaggcgaacccacatatcagatgaagaagcaaacctcttcgccatgcaactaccaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 8998 - DNA, 349 bp, Artificial
  MsCOMT deletion introduced by TALEN pair MsCOMT_T01.1
tctcacaaaaacctcatcaatcacaaccatgggttcaacaggcgaaactcatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 8999 - DNA, 358 bp, Artificial
  MsCOMT deletion introduced by TALEN pair MsCOMT_T01.1
tctcacaaaaacctcatcaatcacaaccatgggttcaacaggcgaaactcaactaccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9000 - DNA, 356 bp, Artificial
  MsCOMT deletion introduced by TALEN pair MsCOMT_T01.1
tctcacaaaaacctcatcaatcacaaccatgggttcaacaggcgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9001 - DNA, 434 bp, Artificial
  MsCOMT deletion introduced by TALEN pair MsCOMT_T01.1
tctcacaaaaacctcatcaatcacaaccatgggttcaacaggcgaaactcaaatggcacagcaccggcaacagccgctggaccgtctccagcgcctgcttgccaccgccatggctggcgatggccaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9002 - DNA, 361 bp, Artificial
  MsCOMT deletion introduced by TALEN pair MsCOMT_T01.1
tctcacaaaaacctcatcaatcacaaccatgggttcaacaggcgaaactcaaatcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9003 - DNA, 351 bp, Artificial
  MsCOMT deletion introduced by TALEN pair MsCOMT_T01.1
tctcacaaaaacctcatcaatcacaaccatgggttcaacaggcgaaactcaaatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9004 - DNA, 359 bp, Artificial
  MsCOMT deletion introduced by TALEN pair MsCOMT_T01.1
tctcacaaaaacctcatcaatcacaaccatgggttcaacaggcgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaacccttatacaccagttatgttggaccgaatgttgcgtctcttggcttgttacaatatcctcacttgttcagttcgtactcaaccagatgggaagattcagagactttatggtttggctactgttgctaa

SEQ ID NO: 9005 - DNA, 359 bp, Artificial
  MsCOMT deletion introduced by TALEN pair MsCOMT_T01.1
tctcacaaaaacctcatcaatcacaaccatgggttcaacaggcgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9006 - DNA, 358 bp, Artificial
  MsCOMT deletion introduced by TALEN pair MsCOMT_T01.1
tctcacaaaaacctcatcaatcacaaccatgggttcaacaggcgaaactcaaataccacatatcagatgaagaagcaaacctcttcgccctgcaactatcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9007 - DNA, 358 bp, Artificial
  MsCOMT deletion introduced by TALEN pair MsCOMT_T01.1
tctcacaaaaacctcatcaatcacaaccatgggttcaacaggcgaaactcaaataccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9008 - DNA, 358 bp, Artificial
  MsCOMT deletion introduced by TALEN pair MsCOMT_T01.1
tctcacaaaaacctcatcaatcacaaccatgggttcaacaggcgaaactcaaataccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9009 - DNA, 358 bp, Artificial
  MsCOMT deletion introduced by TALEN pair MsCOMT_T01.1
tctcacaaaaacctcatcaatcacaaccatgggttcaacaggcgaaactcaaataccacatatcagatgaagaagcaaacctcttcgccatgcaactatcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9010 - DNA, 358 bp, Artificial
  MsCOMT deletion introduced by TALEN pair MsCOMT_T01.1
tctcacaaaaacctcatcaatcacaaccatgggttcaacaggcgaaactcaaataccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9011 - DNA, 358 bp, Artificial
  MsCOMT deletion introduced by TALEN pair MsCOMT_T01.1
tctcacaaaaacctcatcaatcacaaccatgggttcaacaggcgaaactcaaataccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9012 - DNA, 358 bp, Artificial
  MsCOMT deletion introduced by TALEN pair MsCOMT_T01.1
tctcacaaaaacctcatcaatcacaaccatgggttcaacaggcgaaactcaaataccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9013 - DNA, 358 bp, Artificial
  MsCOMT deletion introduced by TALEN pair MsCOMT_T01.1
tctcacaaaaacctcatcaatcacaaccatgggttcaacaggcgaaactcaaataccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9014 - DNA, 358 bp, Artificial
  MsCOMT deletion introduced by TALEN pair MsCOMT_T01.1
tctcacaaaaacctcatcaatcacaaccatgggttcaacaggcgaaactcaaataccacatatcagatgaagaagcaaacctcttcgccatgcaactagcaagtgcttcagttcttcccatgattttaaaatcagctcttgaacttgatcccttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9015 - DNA, 358 bp, Artificial
  MsCOMT deletion introduced by TALEN pair MsCOMT_T01.1
tctcacaaaaacctcatcaatcacaaccatgggttcaacaggcgaaactcaaataccacatatcagatgaagaagcaaacctcttcgccatgcaactagcaagtgcttcagttcttcccatgattgtgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9016 - DNA, 363 bp, Artificial
  MsCOMT deletion introduced by TALEN pair MsCOMT_T01.1
tctcacaaaaacctcatcaatcacaaccatgggttcaacaggcgaaactcaaataccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgtgtctcttggcttgttacaatatcctcacttgttcagttcgtactcaacaagatggaaaagttcagagactttatggtttggctactgttgctaa

SEQ ID NO: 9017 - DNA, 365 bp, Artificial
  MsCOMT deletion introduced by TALEN pair MsCOMT_T01.1
tctcacaaaaacctcatcaatcacaaccatgggttcaacaggcgaaactcaaatacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9018 - DNA, 363 bp, Artificial
  MsCOMT deletion introduced by TALEN pair MsCOMT_T01.1
tctcacaaaaacctcatcaatcacaaccatgggttcaacaggcgaaactcaaataactacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgagtctcttggcttgttacaatatcctcacttgttcagttcgtacacaacaagatggaaaggttcagagactttatggtttggctacggttgctaa

SEQ ID NO: 9019 - DNA, 360 bp, Artificial
  MsCOMT deletion introduced by TALEN pair MsCOMT_T01.1
tctcacaaaaacctcatcaatcacaaccatgggttcaacaggcgaaactcaaataacccacatatcatatgaagaagcaaacctcttcgccatgcaattatcaagtgcttcagttcttcccatgattttaaaatcagctcttgaacttgatctcttagaaatcattgctaaagctggacctggtgctcaaatttcgcctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9020 - DNA, 360 bp, Artificial
  MsCOMT deletion introduced by TALEN pair MsCOMT_T01.1
tctcacaaaaacctcatcaatcacaaccatgggttcaacaggcgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9021 - DNA, 360 bp, Artificial
  MsCOMT deletion introduced by TALEN pair MsCOMT_T01.1
tctcacaaaaacctcatcaatcacaaccatgggttcaacaggcgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctaaaatttcacctattgaaattgcttctcagctaccaacaactaaccctgatgcaccagttatgttggaccgaatgttgcgtctcttggcttgttacaatatcctcacttgatcagttcgtactcaacaagatggaaaggttcagagactttatggtttggctactgttgctaa

SEQ ID NO: 9022 - DNA, 360 bp, Artificial
  MsCOMT deletion introduced by TALEN pair MsCOMT_T01.1
tctcacaaaaacctcatcaatcacaaccatgggttcaacaggcgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9023 - DNA, 417 bp, Artificial
  MsCOMT deletion introduced by TALEN pair MsCOMT_T01.1
tctcacaaaaacctcatcaatcacaaccatgggttcaacaggcgaaactcaaataacaccggtatcttcgagccagccgcgatcgacattgatctggctatcttgctgaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9024 - DNA, 361 bp, Artificial
  MsCOMT deletion introduced by TALEN pair MsCOMT_T01.1
tctcacaaaaacctcatcaatcacaaccatgggttcaacaggcgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9025 - DNA, 361 bp, Artificial
  MsCOMT deletion introduced by TALEN pair MsCOMT_T01.1
tctcacaaaaacctcatcaatcacaaccatgggttcaacaggcgaaactcaaataaacccacatatcagatgaagaagcaaacctcttcgccatgcaattaccaagtgcttcagttcttcccatgattttaaaatcagctcttgaacttgatctcttagaaatcattgctacagctggacctggtgctcaaatttcacctgttcaaattgcttctcagcttccaacaactaaccctgatgcaccagtcatgttggaccgaatgttgcgtctcttggcttgttacaatatcctcacttgttcaggtcgtgctcaaccagatggaaagattcagagactttatggtttcgctactgttgctaa

SEQ ID NO: 9026 - DNA, 361 bp, Artificial
  MsCOMT deletion introduced by TALEN pair MsCOMT_T01.1
tctcacaaaaacctcatcaatcacaaccatgggttcaacaggcgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9027 - DNA, 361 bp, Artificial
  MsCOMT deletion introduced by TALEN pair MsCOMT_T01.1
tctcacaaaaacctcatcaatcacaaccatgggttcaacaggcgaaactcaaataaacccacatatcagatgaagaagcaaacctcttcgccacgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9028 - DNA, 362 bp, Artificial
  MsCOMT deletion introduced by TALEN pair MsCOMT_T01.1
tctcacaaaaacctcatcaatcacaaccatgggttcaacaggcgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9029 - DNA, 357 bp, Artificial
  MsCOMT deletion introduced by TALEN pair MsCOMT_T01.1
tctcacaaaaacctcatcaatcacaaccatgggttcaacaggcgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9030 - DNA, 357 bp, Artificial
  MsCOMT deletion introduced by TALEN pair MsCOMT_T01.1
tctcacaaaaacctcatcaatcacaaccatgggttcaacaggcgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9031 - DNA, 357 bp, Artificial
  MsCOMT deletion introduced by TALEN pair MsCOMT_T01.1
tctcacaaaaacctcatcaatcacaaccatgggttcaacaggcgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9032 - DNA, 359 bp, Artificial
  MsCOMT deletion introduced by TALEN pair MsCOMT_T01.1
tctcacaaaaacctcatcaatcacaaccatgggttcaacaggcgaaactcaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9033 - DNA, 352 bp, Artificial
  MsCOMT deletion introduced by TALEN pair MsCOMT_T01.1
tctcacaaaaacctcatcaatcacaaccatgggttcaacaggcgaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9034 - DNA, 348 bp, Artificial
  MsCOMT deletion introduced by TALEN pair MsCOMT_T01.1
tctcacaaaaacctcatcaatcacaaccatgggttcaacaggcacccacctatcagataaagaagcaaacctcttcgacatgcaactagcaagtgcttcatttcttcccatgattttgaaatcagctcttgaacttgatctcttagaaatcattgctaaagctggacctgttgctcaaattttacctattgaaatttcttctcagctaccaacaactaaccctgatgcaccagttatgttggaccgaatgttgcgtctcttggcttgttacaatatcctcacttgttcagttcttactcaacaagatggaaagattcagagcctttatggtttggctactgttgctaa

SEQ ID NO: 9035 - DNA, 348 bp, Artificial
  MsCOMT deletion introduced by TALEN pair MsCOMT_T01.1
tctcacaaaaacctcatcaatcacaaccatgggttcaacaggcacccacatatcagattaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9036 - DNA, 348 bp, Artificial
  MsCOMT deletion introduced by TALEN pair MsCOMT_T01.1
tctcacaaaaacctcatcaatcacaaccatgggttcaacaggcacccacatatcagattaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9037 - DNA, 348 bp, Artificial
  MsCOMT deletion introduced by TALEN pair MsCOMT_T01.1
tctcacaaaaacctcatcaatcacaaccatgggttcaacaggcacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9038 - DNA, 348 bp, Artificial
  MsCOMT deletion introduced by TALEN pair MsCOMT_T01.1
tctcacaaaaacctcatcaatcacaaccatgggttcaacaggcacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 9039 - DNA, 348 bp, Artificial
  MsCOMT deletion introduced by TALEN pair MsCOMT_T01.1
tctcacaaaaacctcatcaatcacaaccatgggttcaacaggcacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 9040 - DNA, 348 bp, Artificial
  MsCOMT deletion introduced by TALEN pair MsCOMT_T01.1
tctcacaaaaacctcatcaatcacaaccatgggttcaacaggcacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9041 - DNA, 348 bp, Artificial
  MsCOMT deletion introduced by TALEN pair MsCOMT_T01.1
tctcacaaaaacctcatcaatcacaaccatgggttcaacaggcacccacatatcagatgaagaagcaaacctcttcgccatgcaactagcaagtgcttcagttcttcccatgattttgaaatcagctcttgaacttgatctcttagaaatcattgctaaaactggacctggtgctcaaatttcacctattgaaattgcttctcagctaccaacaactaaccctgatgcaccagttatgttggaccgtatgttgcgtctcttggcttgttacaatatcctcacttgttcagttcgtactcaacaagatggaaaggttcagagactttatggtttggctactgttgctaa

SEQ ID NO: 9042 - DNA, 360 bp, Artificial
  MsCOMT deletion introduced by TALEN pair MsCOMT_T01.1
tctcacaaaaacctcatcaatcacaaccatgggttcaacaggagaaactcaaataacccacatatcagatgaagaagcaaacatcttcgccatgcaactagcaagtgcttcagttcatcccatgattttgaaatcagctcttgaacttgatctcttagaaatcattgctaaagctggacctggtgctcaaatttcacctattgaaattgcttctcagctcccaacaactacccctgatgcaccagttatgttgtaccgaatgttgcgtctcttggcttgttacaatatcttcacttgttcatttcgtactcaacaagatggaaaggttcagagactttatggtttggctactgttgctaa

SEQ ID NO: 9043 - DNA, 348 bp, Artificial
  MsCOMT deletion introduced by TALEN pair MsCOMT_T01.1
tctcacaaaaacctcatcaatcacaaccatgggttcaacaggaacccacatatcagattaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9044 - DNA, 348 bp, Artificial
  MsCOMT deletion introduced by TALEN pair MsCOMT_T01.1
tctcacaaaaacctcatcaatcacaaccatgggttcaacaggaacccacatatcagattaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9045 - DNA, 348 bp, Artificial
  MsCOMT deletion introduced by TALEN pair MsCOMT_T01.1
tctcacaaaaacctcatcaatcacaaccatgggttcaacaggaacccacatatcagattaagaagcaaacctcttcgccatgcaactagcaagtgcttcagttcttcccatgattttgaaatcagctcctgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9046 - DNA, 348 bp, Artificial
  MsCOMT deletion introduced by TALEN pair MsCOMT_T01.1
tctcacaaaaacctcatcaatcacaaccatgggttcaacaggaacccacatatcagattaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9047 - DNA, 348 bp, Artificial
  MsCOMT deletion introduced by TALEN pair MsCOMT_T01.1
tctcacaaaaacctcatcaatcacaaccatgggttcaacaggaacccacatatcagatgaagaagcaaacttcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9048 - DNA, 348 bp, Artificial
  MsCOMT deletion introduced by TALEN pair MsCOMT_T01.1
tctcacaaaaacctcatcaatcacaaccatgggttcaacaggaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9049 - DNA, 348 bp, Artificial
  MsCOMT deletion introduced by TALEN pair MsCOMT_T01.1
tctcacaaaaacctcatcaatcacaaccatgggttcaacaggaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9050 - DNA, 348 bp, Artificial
  MsCOMT deletion introduced by TALEN pair MsCOMT_T01.1
tctcacaaaaacctcatcaatcacaaccatgggttcaacaggaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9051 - DNA, 348 bp, Artificial
  MsCOMT deletion introduced by TALEN pair MsCOMT_T01.1
tctcacaaaaacctcatcaatcacaaccatgggttcaacaggaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9052 - DNA, 348 bp, Artificial
  MsCOMT deletion introduced by TALEN pair MsCOMT_T01.1
tctcacaaaaacctcatcaatcacaaccatgggttcaacaggaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgatggaccgaatgttgcgtctcttggcttgttacaatatcctcacttgttcagttcgtactcaacaagatggaaagattcagagactttatggtttggctactgttgctaa

SEQ ID NO: 9053 - DNA, 348 bp, Artificial
  MsCOMT deletion introduced by TALEN pair MsCOMT_T01.1
tctcacaaaaacctcatcaatcacaaccatgggttcaacaggaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 9054 - DNA, 348 bp, Artificial
  MsCOMT deletion introduced by TALEN pair MsCOMT_T01.1
tctcacaaaaacctcatcaatcacaaccatgggttcaacaggaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 9055 - DNA, 348 bp, Artificial
  MsCOMT deletion introduced by TALEN pair MsCOMT_T01.1
tctcacaaaaacctcatcaatcacaaccatgggttcaacaggaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9056 - DNA, 348 bp, Artificial
  MsCOMT deletion introduced by TALEN pair MsCOMT_T01.1
tctcacaaaaacctcatcaatcacaaccatgggttcaacaggaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9057 - DNA, 348 bp, Artificial
  MsCOMT deletion introduced by TALEN pair MsCOMT_T01.1
tctcacaaaaacctcatcaatcacaaccatgggttcaacaggaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 9058 - DNA, 348 bp, Artificial
  MsCOMT deletion introduced by TALEN pair MsCOMT_T01.1
tctcacaaaaacctcatcaatcacaaccatgggttcaacaggaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9059 - DNA, 348 bp, Artificial
  MsCOMT deletion introduced by TALEN pair MsCOMT_T01.1
tctcacaaaaacctcatcaatcacaaccatgggttcaacaggaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9060 - DNA, 348 bp, Artificial
  MsCOMT deletion introduced by TALEN pair MsCOMT_T01.1
tctcacaaaaacctcatcaatcacaaccatgggttcaacaggaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgcgaa

SEQ ID NO: 9061 - DNA, 348 bp, Artificial
  MsCOMT deletion introduced by TALEN pair MsCOMT_T01.1
tctcacaaaaacctcatcaatcacaaccatgggttcaacaggaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9062 - DNA, 348 bp, Artificial
  MsCOMT deletion introduced by TALEN pair MsCOMT_T01.1
tctcacaaaaacctcatcaatcacaaccatgggttcaacaggaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9063 - DNA, 348 bp, Artificial
  MsCOMT deletion introduced by TALEN pair MsCOMT_T01.1
tctcacaaaaacctcatcaatcacaaccatgggttcaacaggaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9064 - DNA, 348 bp, Artificial
  MsCOMT deletion introduced by TALEN pair MsCOMT_T01.1
tctcacaaaaacctcatcaatcacaaccatgggttcaacaggaacccacatatcagatgaagaagcaaacctcttcgccaagcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9065 - DNA, 348 bp, Artificial
  MsCOMT deletion introduced by TALEN pair MsCOMT_T01.1
tctcacaaaaacctcatcaatcacaaccatgggttcaacaggaacccacatatcagataaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9066 - DNA, 361 bp, Artificial
  MsCOMT deletion introduced by TALEN pair MsCOMT_T01.1
tctcacaaaaacctcatcaatcacaaccatgggttcaacagctgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9067 - DNA, 360 bp, Artificial
  MsCOMT deletion introduced by TALEN pair MsCOMT_T01.1
tctcacaaaaacctcatcaatcacaaccatgggttcaacagcgaaactcaaatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctctcggcttgttacaatatcctcacttgttcagttcgtactcaacaagatggaaaggttcagagactttatggtttggctactgttgctaa

SEQ ID NO: 9068 - DNA, 350 bp, Artificial
  MsCOMT deletion introduced by TALEN pair MsCOMT_T01.1
tctcacaaaaacctcatcaatcacaaccatgggttcaacagcagaacccacacatcagatgaaaaagcaaacctcttcgccatgcaactagcaagagcttcagttcttcccatgattttgaaatcagctcttgaacttgatctcttagaaatcattgctaaagctggacctggtgctcaaatttcacctattgaaattgcttctcagctaccaacaactaaccctcgtgcaacagttatgttggaccgaatgttgcgtctcttggcttattacaataacctctcttgttcggttcgtactcaacaagatggaaaagttcggagtctttgtggtttggctactgttgctag

SEQ ID NO: 9069 - DNA, 332 bp, Artificial
  MsCOMT deletion introduced by TALEN pair MsCOMT_T01.1
tctcacaaaaacctcatcaatcacaaccatgggttcaacagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaggttcagagactttatggtttggctactgttgctaa

SEQ ID NO: 9070 - DNA, 359 bp, Artificial
  MsCOMT deletion introduced by TALEN pair MsCOMT_T01.1
tctcacaaaaacctcatcaatcacaaccatgggttcaacagatgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9071 - DNA, 360 bp, Artificial
  MsCOMT deletion introduced by TALEN pair MsCOMT_T01.1
tctcacaaaaacctcatcaatcacaaccatgggttcaacagatgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9072 - DNA, 360 bp, Artificial
  MsCOMT deletion introduced by TALEN pair MsCOMT_T01.1
tctcacaaaaacctcatcaatcacaaccatgggttcaacagatgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9073 - DNA, 360 bp, Artificial
  MsCOMT deletion introduced by TALEN pair MsCOMT_T01.1
tctcacaaaaacctcatcaatcacaaccatgggttcaacagatgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9074 - DNA, 361 bp, Artificial
  MsCOMT deletion introduced by TALEN pair MsCOMT_T01.1
tctcacaaaaacctcatcaatcacaaccatgggttcaacagatgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9075 - DNA, 357 bp, Artificial
  MsCOMT deletion introduced by TALEN pair MsCOMT_T01.1
tctcacaaaaacctcatcaatcacaaccatgggttcaacagatgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9076 - DNA, 357 bp, Artificial
  MsCOMT deletion introduced by TALEN pair MsCOMT_T01.1
tctcacaaaaacctcatcaatcacaaccatgggttcaacagatgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9077 - DNA, 361 bp, Artificial
  MsCOMT deletion introduced by TALEN pair MsCOMT_T01.1
tctcacaaaaacctcatcaatcacaaccatgggttcaacagatgaaactcaaaccaacccacatatcagatgaagaagcaaacctcttcgccatgcaactagcaagtgcttcagttcttcccatgattttgaaatcagctcttgaacttgatctcttagaaatcattgctaaagctggacctggtgcacaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9078 - DNA, 360 bp, Artificial
  MsCOMT deletion introduced by TALEN pair MsCOMT_T01.1
tctcacaaaaacctcatcaatcacaaccatgggttcaacagatgaaactcaaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9079 - DNA, 351 bp, Artificial
  MsCOMT deletion introduced by TALEN pair MsCOMT_T01.1
tctcacaaaaacctcatcaatcacaaccatgggttcaacagatgaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9080 - DNA, 360 bp, Artificial
  MsCOMT deletion introduced by TALEN pair MsCOMT_T01.1
tctcacaaaaacctcatcaatcacaaccatgggttcaacacgtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatgtaaaggttcagagactttatggtttggctactgttgctaa

SEQ ID NO: 9081 - DNA, 344 bp, Artificial
  MsCOMT deletion introduced by TALEN pair MsCOMT_T01.1
tctcacaaaaacctcatcaatcacaaccatgggttcaacacccacatatcagatgtagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagacattatggtttggctactgttgctaa

SEQ ID NO: 9082 - DNA, 344 bp, Artificial
  MsCOMT deletion introduced by TALEN pair MsCOMT_T01.1
tctcacaaaaacctcatcaatcacaaccatgggttcaacacccacatatcagatgcagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9083 - DNA, 344 bp, Artificial
  MsCOMT deletion introduced by TALEN pair MsCOMT_T01.1
tctcacaaaaacctcatcaatcacaaccatgggttcaacacccacatatcagatgaagtagcaaacctcttcgccatgcaactcgcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 9084 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaccctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9085 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgtcatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9086 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcacttagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9087 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9088 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9089 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9090 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9091 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctat

SEQ ID NO: 9092 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9093 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaattagcaagtgcttcagttcttcccatgattttaaaatcggctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9094 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 9095 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 9096 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9097 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9098 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 9099 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9100 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9101 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9102 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctctcttgttcagttcgtactcaacaagatggaaagattcagagactttatggtttggctactgttgctaa

SEQ ID NO: 9103 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 9104 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9105 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 9106 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9107 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9108 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtcacttggcttgttacaatatcctcacttgttcagttcgtactcaacaagatggaaagattcagagactttatggtttggctactgttgctaa

SEQ ID NO: 9109 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaattagcaagtgcttcagttcttcccatgattttaaaatcagctcttgaacttgatctcttagaaatcattgctaaagctggacctggtactcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 9110 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaattagcaagtgcttcagttcttcccatgattttaaaatcagctcttgaacttgatctcttagaaatcattgctaaagctggacccggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9111 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaattagcaagtgcttcagttcttcccatgatttcaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 9112 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaattagcaagtgcttcagttcttcccatgatttaaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9113 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaactagcaagtgtttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcggagactttatggtttggctactgttgctaa

SEQ ID NO: 9114 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaactagcaagtgtttcagttcttcccatgattttcaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 9115 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaactagcaagtgcttcagttcttcccatgattttgaaatcagctcttgaacttgatctcttataaatcattgctaaagctggacctggtgctcaaatttcacctattgaaattgcttctcagctaccaacaactaaccctgatgcaccagttatgttggaccgaatgttgcgtctcttcgcttgttacaatatcctcacttgttctgttcgtactcaacaagatggaaaggttcagagactttatggtttggctactgttgctaa

SEQ ID NO: 9116 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9117 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacctgttcagttcgtactcaacaagatggaaaggttcagagactttatggtttggctactgttgctaa

SEQ ID NO: 9118 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 9119 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 9120 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9121 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9122 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactagccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9123 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9124 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9125 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9126 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctctcttgttcagttcgtactcaacaagatggaaagattcagagactttatggtttggctactgttgctaa

SEQ ID NO: 9127 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 9128 - DNA, 336 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctaaa

SEQ ID NO: 9129 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacagctaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9130 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccggttatgttggaccgaatgttgcgtctcttggcttgttacaatatcctcacttgttcagttcatactcaacaagatggaaagattcagagactttatggtttggctactgttgctaa

SEQ ID NO: 9131 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgtcacaatatcctcacttgttcagttcgtactcaacaagatggaaaggttcagagactttatggtttggctactgttgctaa

SEQ ID NO: 9132 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9133 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9134 - DNA, 343 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 9135 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9136 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcatgttacaatatcctcacttgttcagttcgtactcaacaagatggaaaggttcagagactttatggtttggctactgttgctaa

SEQ ID NO: 9137 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactgtatggtttggctactgttgctaa

SEQ ID NO: 9138 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgtttcaatatcctcacttgttcagttcgtactcaacaagatggaaaggttcagagactttatggtttggctactgttgctaa

SEQ ID NO: 9139 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 9140 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 9141 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatttcctcacttgttcagttcgtactcaacaagatggaaaggttcagagactttatggtttggctactgttgctaa

SEQ ID NO: 9142 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccaaatgttgcgtctcttggcttgttacaatatcctcacttgttcagttcgtactcaacaagatggaaaagttcagagactttatggtttggctactgttgctaa

SEQ ID NO: 9143 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 9144 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaactagcaagtgcttcagttcttcccatgattttgaaatcagctcttgaacttgatcacttagaaatcattgctaaagctggacctggtgctcaaatttcacctattgaaattgcttctcagctcccaacaactaaccctgatgcaccagttatgttggaccgaatgttgcgtctcttggcttgttacgatatcctcacttgttcagttcgtactcaacaagatggaaaggttcagagactttatggtttggctactgttgctaa

SEQ ID NO: 9145 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaactagcaagtgcttcagttcttcccatgattttaaaatcagctcttggacttgatctcttagaaatcattgctaaagctggacctggtgctcaaatttcacctattgaaattgcttctcagctcccaacaactgaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9146 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaactagcaagtgcttcagttcttcccatgattttaaaatcagctcttgaacttgatctcttataaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9147 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaactagcaagtgcttcagttcttcccatgattttaaaatcagctcttgaacttgatctcttataaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9148 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaactagcaagtgcttcagttcttcccatgattttaaaatcagctcttgaacttgatctcttagagatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9149 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 9150 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 9151 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9152 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgtttagttcgtactcaacaagatggaaaggttcagagactttatggtttggctactgttgctaa

SEQ ID NO: 9153 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9154 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 9155 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 9156 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9157 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9158 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9159 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaactagcaagtgcttcagttcttcccatgattttaaaatcagctcttgaacttgatctcttagaaatcattgctaaagctggacctggtgcacaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9160 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaactagcaagtgcttcagttcttcacatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9161 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaactagcaagtgcgtcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9162 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaactagcaagtgcatcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9163 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatgcaaccagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 9164 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttcgccatacaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 9165 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttccccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9166 - DNA, 344 bp, Artificial
  MsCOMT deletion introduced by TALEN pair MsCOMT_T01.1
tctcacaaaaacctcatcaatcacaaccatgggttcaacacccacatatcagatgaagaagcaaacctcttagccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9167 - DNA, 344 bp, Artificial
  MsCOMT deletion introduced by TALEN pair MsCOMT_T01.1
tctcacaaaaacctcatcaatcacaaccatgggttcaacacccacagatcagatgaagaagcaaacctcttcgccatgcaattagcaagtgcttcagttcttcccatgattttaaaatcagctcttgaacttgatctcttagaaatcatttctaaagctggacctggtgctcaaatttcacctattgaaattgcttctcagctcccaacaactaaccctgatgcaccagttatgtttgaccgaatgttgcgtctcttggcttgttactatatcctcacttgttcagttcgtactcaacaagatggaaaggttcagagactttatggtttgcctactgttgctaa

SEQ ID NO: 9168 - DNA, 347 bp, Artificial
  MsCOMT deletion introduced by TALEN pair MsCOMT_T01.1
tctcacaaaaacctcatcaatcacaaccatgggttcaacacaccccacatatccgatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9169 - DNA, 347 bp, Artificial
  MsCOMT deletion introduced by TALEN pair MsCOMT_T01.1
tctcacaaaaacctcatcaatcacaaccatgggttcaacacaccccacatatccgatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9170 - DNA, 347 bp, Artificial
  MsCOMT deletion introduced by TALEN pair MsCOMT_T01.1
tctcacaaaaacctcatcaatcacaaccatgggttcaacacaccccacatatccgatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9171 - DNA, 347 bp, Artificial
  MsCOMT deletion introduced by TALEN pair MsCOMT_T01.1
  misc_feature (347): n is a or c or t or g
tctcacaaaaacctcatcaatcacaaccatgggttcaacacaccccacatatcagatgaagaatcaaacctcttcgccatgccattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctan

SEQ ID NO: 9172 - DNA, 347 bp, Artificial
  MsCOMT deletion introduced by TALEN pair MsCOMT_T01.1
tctcacaaaaacctcatcaatcacaaccatgggttcaacacaccccacatatcagatgaagaatcaaacctcttcgccatgccactagcaagtgcttcagttcttcccatgattttgaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 9173 - DNA, 347 bp, Artificial
  MsCOMT deletion introduced by TALEN pair MsCOMT_T01.1
tctcacaaaaacctcatcaatcacaaccatgggttcaacacaccccacatatcagatgaagaatcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgataa

SEQ ID NO: 9174 - DNA, 347 bp, Artificial
  MsCOMT deletion introduced by TALEN pair MsCOMT_T01.1
tctcacaaaaacctcatcaatcacaaccatgggttcaacacaccccacatatcagatgaagaagcaaacctcttcgccatgccattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctctcttgttcagttcgtactcaacaagatggaaagattcagagactttatggtttggctactgttgctaa

SEQ ID NO: 9175 - DNA, 347 bp, Artificial
  MsCOMT deletion introduced by TALEN pair MsCOMT_T01.1
tctcacaaaaacctcatcaatcacaaccatgggttcaacacaccccacatatcagatgaagaagcaaacctcttcgccatgcaattagtaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9176 - DNA, 347 bp, Artificial
  MsCOMT deletion introduced by TALEN pair MsCOMT_T01.1
tctcacaaaaacctcatcaatcacaaccatgggttcaacacaccccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9177 - DNA, 347 bp, Artificial
  MsCOMT deletion introduced by TALEN pair MsCOMT_T01.1
tctcacaaaaacctcatcaatcacaaccatgggttcaacacaccccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9178 - DNA, 347 bp, Artificial
  MsCOMT deletion introduced by TALEN pair MsCOMT_T01.1
tctcacaaaaacctcatcaatcacaaccatgggttcaacacaccccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9179 - DNA, 347 bp, Artificial
  MsCOMT deletion introduced by TALEN pair MsCOMT_T01.1
tctcacaaaaacctcatcaatcacaaccatgggttcaacacaccccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9180 - DNA, 347 bp, Artificial
  MsCOMT deletion introduced by TALEN pair MsCOMT_T01.1
tctcacaaaaacctcatcaatcacaaccatgggttcaacacaccccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacccattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9181 - DNA, 347 bp, Artificial
  MsCOMT deletion introduced by TALEN pair MsCOMT_T01.1
tctcacaaaaacctcatcaatcacaaccatgggttcaacacaccccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 9182 - DNA, 347 bp, Artificial
  MsCOMT deletion introduced by TALEN pair MsCOMT_T01.1
tctcacaaaaacctcatcaatcacaaccatgggttcaacacaccccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9183 - DNA, 347 bp, Artificial
  MsCOMT deletion introduced by TALEN pair MsCOMT_T01.1
tctcacaaaaacctcatcaatcacaaccatgggttcaacacaccccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 9184 - DNA, 347 bp, Artificial
  MsCOMT deletion introduced by TALEN pair MsCOMT_T01.1
tctcacaaaaacctcatcaatcacaaccatgggttcaacacaacccacatatccgatgaagaagcaaacctcttcgccatgcaattagcaagtgcttcagttcttcccatgattttaaaatcagctcttgaacttgatctcttagaaatcattgctaaagctggacctgatgctcaaatttcacctatttaaattgcttctcagctcccaacaactaaccctgatgcaccagttatgtttgaccgaatgttgcgtctcttggcttgttacaatatcctcacttgttcagttcgtactcaacaagatggaaagattcagagactttatggtttggctactgttgctaa

SEQ ID NO: 9185 - DNA, 347 bp, Artificial
  MsCOMT deletion introduced by TALEN pair MsCOMT_T01.1
tctcacaaaaacctcatcaatcacaaccatgggttcaacacaacccacatatccgatgaagaaccaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9186 - DNA, 346 bp, Artificial
  MsCOMT deletion introduced by TALEN pair MsCOMT_T01.1
tctcacaaaaacctcatcaatcacaaccatgggttcaacacaacccacatatcagatgaagaatcaaacctcttcgccatgccattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggacgaatgttgcgtctcttggcttgttacaatatcctcacttgttcagttcgtactcaacaagatggaaaggttcagagactttatggtttggctactgttgctaa

SEQ ID NO: 9187 - DNA, 347 bp, Artificial
  MsCOMT deletion introduced by TALEN pair MsCOMT_T01.1
tctcacaaaaacctcatcaatcacaaccatgggttcaacacaacccacatatcagatgaagaatcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9188 - DNA, 347 bp, Artificial
  MsCOMT deletion introduced by TALEN pair MsCOMT_T01.1
tctcacaaaaacctcatcaatcacaaccatgggttcaacacaacccacatatcagatgaagaagcaaacctcttcgccatgccattagcaagtgcttcagttcttcccatgattttgaaatcagctcttgaacttgatctcttagaaatcattgctaaagctggacctggtgctcaaatttcacctgttgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9189 - DNA, 347 bp, Artificial
  MsCOMT deletion introduced by TALEN pair MsCOMT_T01.1
tctcacaaaaacctcatcaatcacaaccatgggttcaacacaacccacatatcagatgaagaagcaaacctcttcgccatgccattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9190 - DNA, 347 bp, Artificial
  MsCOMT deletion introduced by TALEN pair MsCOMT_T01.1
tctcacaaaaacctcatcaatcacaaccatgggttcaacacaacccacatatcagatgaagaagcaaacctcttcgccatgccattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9191 - DNA, 347 bp, Artificial
  MsCOMT deletion introduced by TALEN pair MsCOMT_T01.1
tctcacaaaaacctcatcaatcacaaccatgggttcaacacaacccacatatcagatgaagaagcaaacctcttcgccatgccattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9192 - DNA, 346 bp, Artificial
  MsCOMT deletion introduced by TALEN pair MsCOMT_T01.1
tctcacaaaaacctcatcaatcacaaccatgggttcaacacaacccacatatcagatgaagaagcaaacctcttcgccatgccattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatttcctcacttgttcagttcgtactcaccaagatggaaaggttccgagcctttatggtttgctactgttgctaa

SEQ ID NO: 9193 - DNA, 347 bp, Artificial
  MsCOMT deletion introduced by TALEN pair MsCOMT_T01.1
tctcacaaaaacctcatcaatcacaaccatgggttcaacacaacccacatatcagatgaagaagcaaacctcttcgccatgccattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9194 - DNA, 347 bp, Artificial
  MsCOMT deletion introduced by TALEN pair MsCOMT_T01.1
tctcacaaaaacctcatcaatcacaaccatgggttcaacacaacccacatatcagatgaagaagcaaacctcttcgccatgccactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 9195 - DNA, 347 bp, Artificial
  MsCOMT deletion introduced by TALEN pair MsCOMT_T01.1
tctcacaaaaacctcatcaatcacaaccatgggttcaacacaacccacatatcagatgaagaagcaaacctcttcgccatgcaattagcaagtgcttcagttcttcccatgattttgaaatcagctcttgaacttgatctcttagaaatcattgctaacgctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 9196 - DNA, 347 bp, Artificial
  MsCOMT deletion introduced by TALEN pair MsCOMT_T01.1
tctcacaaaaacctcatcaatcacaaccatgggttcaacacaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 9197 - DNA, 347 bp, Artificial
  MsCOMT deletion introduced by TALEN pair MsCOMT_T01.1
tctcacaaaaacctcatcaatcacaaccatgggttcaacacaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9198 - DNA, 347 bp, Artificial
  MsCOMT deletion introduced by TALEN pair MsCOMT_T01.1
tctcacaaaaacctcatcaatcacaaccatgggttcaacacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 9199 - DNA, 347 bp, Artificial
  MsCOMT deletion introduced by TALEN pair MsCOMT_T01.1
tctcacaaaaacctcatcaatcacaaccatgggttcaacacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 9200 - DNA, 347 bp, Artificial
  MsCOMT deletion introduced by TALEN pair MsCOMT_T01.1
tctcacaaaaacctcatcaatcacaaccatgggttcaacacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9201 - DNA, 347 bp, Artificial
  MsCOMT deletion introduced by TALEN pair MsCOMT_T01.1
tctcacaaaaacctcatcaatcacaaccatgggttcaacacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9202 - DNA, 347 bp, Artificial
  MsCOMT deletion introduced by TALEN pair MsCOMT_T01.1
tctcacaaaaacctcatcaatcacaaccatgggttcaacacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcatggcttgttacaatatcctcacttgttcagttcgtactcaacaagatggaaaggttcagagactttatggtttggctactgttgctaa

SEQ ID NO: 9203 - DNA, 347 bp, Artificial
  MsCOMT deletion introduced by TALEN pair MsCOMT_T01.1
tctcacaaaaacctcatcaatcacaaccatgggttcaacacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9204 - DNA, 347 bp, Artificial
  MsCOMT deletion introduced by TALEN pair MsCOMT_T01.1
tctcacaaaaacctcatcaatcacaaccatgggttcaacacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttacgtctcttggcttgttacaatatcctcacttgttcagttcgtactcaacaagatggaaaggttcagagactttatggtttggctactgttgctaa

SEQ ID NO: 9205 - DNA, 347 bp, Artificial
  MsCOMT deletion introduced by TALEN pair MsCOMT_T01.1
tctcacaaaaacctcatcaatcacaaccatgggttcaacacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9206 - DNA, 347 bp, Artificial
  MsCOMT deletion introduced by TALEN pair MsCOMT_T01.1
tctcacaaaaacctcatcaatcacaaccatgggttcaacacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9207 - DNA, 347 bp, Artificial
  MsCOMT deletion introduced by TALEN pair MsCOMT_T01.1
tctcacaaaaacctcatcaatcacaaccatgggttcaacacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9208 - DNA, 347 bp, Artificial
  MsCOMT deletion introduced by TALEN pair MsCOMT_T01.1
tctcacaaaaacctcatcaatcacaaccatgggttcaacacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactctatggtttggctactgttgctaa

SEQ ID NO: 9209 - DNA, 347 bp, Artificial
  MsCOMT deletion introduced by TALEN pair MsCOMT_T01.1
tctcacaaaaacctcatcaatcacaaccatgggttcaacacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccaattatgttggaccgaatgttgcgtctcttggcttgttacaatatcctcacttgttcagttcgtactcaacaagatggaaaggttcagagactttatggtttggctactgttgctaa

SEQ ID NO: 9210 - DNA, 347 bp, Artificial
  MsCOMT deletion introduced by TALEN pair MsCOMT_T01.1
tctcacaaaaacctcatcaatcacaaccatgggttcaacacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9211 - DNA, 347 bp, Artificial
  MsCOMT deletion introduced by TALEN pair MsCOMT_T01.1
tctcacaaaaacctcatcaatcacaaccatgggttcaacacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9212 - DNA, 347 bp, Artificial
  MsCOMT deletion introduced by TALEN pair MsCOMT_T01.1
tctcacaaaaacctcatcaatcacaaccatgggttcaacacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9213 - DNA, 347 bp, Artificial
  MsCOMT deletion introduced by TALEN pair MsCOMT_T01.1
tctcacaaaaacctcatcaatcacaaccatgggttcaacacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9214 - DNA, 347 bp, Artificial
  MsCOMT deletion introduced by TALEN pair MsCOMT_T01.1
tctcacaaaaacctcatcaatcacaaccatgggttcaacacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9215 - DNA, 346 bp, Artificial
  MsCOMT deletion introduced by TALEN pair MsCOMT_T01.1
tctcacaaaaacctcatcaatcacaaccatgggttcaacacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttgctactgttgctaa

SEQ ID NO: 9216 - DNA, 347 bp, Artificial
  MsCOMT deletion introduced by TALEN pair MsCOMT_T01.1
tctcacaaaaacctcatcaatcacaaccatgggttcaacacaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9217 - DNA, 347 bp, Artificial
  MsCOMT deletion introduced by TALEN pair MsCOMT_T01.1
tctcacaaaaacctcatcaatcacaaccatgggttcaacacaacccacatatcagatgaagaaccaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9218 - DNA, 358 bp, Artificial
  MsCOMT deletion introduced by TALEN pair MsCOMT_T01.1
tctcacaaaaacctcatcaatcacaaccatgggttcaacaagtgaaactcaaataccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9219 - DNA, 360 bp, Artificial
  MsCOMT deletion introduced by TALEN pair MsCOMT_T01.1
tctcacaaaaacctcatcaatcacaaccatgggttcaacaagtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9220 - DNA, 355 bp, Artificial
  MsCOMT deletion introduced by TALEN pair MsCOMT_T01.1
tctcacaaaaacctcatcaatcacaaccatgggttcaacaagtgaaactcaaaaacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 9221 - DNA, 345 bp, Artificial
  MsCOMT deletion introduced by TALEN pair MsCOMT_T01.1
tctcacaaaaacctcatcaatcacaaccatgggttcaacaacccacatatcagctgaataagcaaacctcttcgccatgcaactagcacgtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9222 - DNA, 345 bp, Artificial
  MsCOMT deletion introduced by TALEN pair MsCOMT_T01.1
tctcacaaaaacctcatcaatcacaaccatgggttcaacaacccacatatcagctgaataagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 9223 - DNA, 345 bp, Artificial
  MsCOMT deletion introduced by TALEN pair MsCOMT_T01.1
tctcacaaaaacctcatcaatcacaaccatgggttcaacaacccacatatcagctgaataagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9224 - DNA, 345 bp, Artificial
  MsCOMT deletion introduced by TALEN pair MsCOMT_T01.1
tctcacaaaaacctcatcaatcacaaccatgggttcaacaacccacatatcagctgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9225 - DNA, 345 bp, Artificial
  MsCOMT deletion introduced by TALEN pair MsCOMT_T01.1
tctcacaaaaacctcatcaatcacaaccatgggttcaacaacccacatatcagctgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9226 - DNA, 345 bp, Artificial
  MsCOMT deletion introduced by TALEN pair MsCOMT_T01.1
tctcacaaaaacctcatcaatcacaaccatgggttcaacaacccacatatcagctgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9227 - DNA, 345 bp, Artificial
  MsCOMT deletion introduced by TALEN pair MsCOMT_T01.1
tctcacaaaaacctcatcaatcacaaccatgggttcaacaacccacatatcagatgaataagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 9228 - DNA, 345 bp, Artificial
  MsCOMT deletion introduced by TALEN pair MsCOMT_T01.1
tctcacaaaaacctcatcaatcacaaccatgggttcaacaacccacatatcagatgaataagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9229 - DNA, 345 bp, Artificial
  MsCOMT deletion introduced by TALEN pair MsCOMT_T01.1
tctcacaaaaacctcatcaatcacaaccatgggttcaacaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9230 - DNA, 345 bp, Artificial
  MsCOMT deletion introduced by TALEN pair MsCOMT_T01.1
tctcacaaaaacctcatcaatcacaaccatgggttcaacaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9231 - DNA, 345 bp, Artificial
  MsCOMT deletion introduced by TALEN pair MsCOMT_T01.1
tctcacaaaaacctcatcaatcacaaccatgggttcaacaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcctgttacaatatcctcacttgttcagttcgtactcaacaagatggaaaggttcagagactttatggtttggctactgttgctaa

SEQ ID NO: 9232 - DNA, 345 bp, Artificial
  MsCOMT deletion introduced by TALEN pair MsCOMT_T01.1
tctcacaaaaacctcatcaatcacaaccatgggttcaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9233 - DNA, 345 bp, Artificial
  MsCOMT deletion introduced by TALEN pair MsCOMT_T01.1
tctcacaaaaacctcatcaatcacaaccatgggttcaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9234 - DNA, 345 bp, Artificial
  MsCOMT deletion introduced by TALEN pair MsCOMT_T01.1
tctcacaaaaacctcatcaatcacaaccatgggttcaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9235 - DNA, 344 bp, Artificial
  MsCOMT deletion introduced by TALEN pair MsCOMT_T01.1
tctcacaaaaacctcatcaatcacaaccatgggttcaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttgctactgttgctaa

SEQ ID NO: 9236 - DNA, 345 bp, Artificial
  MsCOMT deletion introduced by TALEN pair MsCOMT_T01.1
tctcacaaaaacctcatcaatcacaaccatgggttcaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttgggccgaatgttgcgtctcttggcttgttacaatatcctcacttgttcagttcgtactcaacaagatggaaaggttcagagactttatggtttggctactgttgctaa

SEQ ID NO: 9237 - DNA, 345 bp, Artificial
  MsCOMT deletion introduced by TALEN pair MsCOMT_T01.1
tctcacaaaaacctcatcaatcacaaccatgggttcaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9238 - DNA, 345 bp, Artificial
  MsCOMT deletion introduced by TALEN pair MsCOMT_T01.1
tctcacaaaaacctcatcaatcacaaccatgggttcaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9239 - DNA, 345 bp, Artificial
  MsCOMT deletion introduced by TALEN pair MsCOMT_T01.1
tctcacaaaaacctcatcaatcacaaccatgggttcaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacgagatggaaaggttcagagactttatggtttggctactgttgctaa

SEQ ID NO: 9240 - DNA, 344 bp, Artificial
  MsCOMT deletion introduced by TALEN pair MsCOMT_T01.1
tctcacaaaaacctcatcaatcacaaccatgggttcaacaacccacatatcagatgaagaagcaaacctcttcgccatgcaataagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgtgcagttcgtactcaacaagatggaaagattcagagactttatggtttggctactttgctaa

SEQ ID NO: 9241 - DNA, 345 bp, Artificial
  MsCOMT deletion introduced by TALEN pair MsCOMT_T01.1
tctcacaaaaacctcatcaatcacaaccatgggttcaacaacccacatatcagatgaagaagcaaacctcttcgccatgcaactagcacgtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9242 - DNA, 345 bp, Artificial
  MsCOMT deletion introduced by TALEN pair MsCOMT_T01.1
tctcacaaaaacctcatcaatcacaaccatgggttcaacaacccacatatcagatgaagaagcaaacctcttcgccatgcaactagcaagttcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9243 - DNA, 345 bp, Artificial
  MsCOMT deletion introduced by TALEN pair MsCOMT_T01.1
tctcacaaaaacctcatcaatcacaaccatgggttcaacaacccacatatcagatgaagaagcaaacctcttcgccatgcaactagcaagtgcttcatttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9244 - DNA, 345 bp, Artificial
  MsCOMT deletion introduced by TALEN pair MsCOMT_T01.1
tctcacaaaaacctcatcaatcacaaccatgggttcaacaacccacatatcagatgaagaagcaaacctcttcgccatgcaactagcaagtgcttcatttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9245 - DNA, 345 bp, Artificial
  MsCOMT deletion introduced by TALEN pair MsCOMT_T01.1
tctcacaaaaacctcatcaatcacaaccatgggttcaacaacccacatatcagatgaagaagcaaacctcttcgccatgcaactagcaagtgcttcagttcttcccatgatttttaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9246 - DNA, 345 bp, Artificial
  MsCOMT deletion introduced by TALEN pair MsCOMT_T01.1
tctcacaaaaacctcatcaatcacaaccatgggttcaacaacccacatatcagatgaagaagcaaacctcttcgccatgcaactagcaagtgcttcagttcttcccatgattttgaaatcagctcttgaacttgatctcttagaaatcatttctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9247 - DNA, 345 bp, Artificial
  MsCOMT deletion introduced by TALEN pair MsCOMT_T01.1
tctcacaaaaacctcatcaatcacaaccatgggttcaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 9248 - DNA, 345 bp, Artificial
  MsCOMT deletion introduced by TALEN pair MsCOMT_T01.1
tctcacaaaaacctcatcaatcacaaccatgggttcaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 9249 - DNA, 345 bp, Artificial
  MsCOMT deletion introduced by TALEN pair MsCOMT_T01.1
tctcacaaaaacctcatcaatcacaaccatgggttcaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 9250 - DNA, 344 bp, Artificial
  MsCOMT deletion introduced by TALEN pair MsCOMT_T01.1
tctcacaaaaacctcatcaatcacaaccatgggttcaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgtacagttcgtactcaacaagatggaaaggttcagagactttatggtttggctctgttgctaa

SEQ ID NO: 9251 - DNA, 345 bp, Artificial
  MsCOMT deletion introduced by TALEN pair MsCOMT_T01.1
tctcacaaaaacctcatcaatcacaaccatgggttcaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9252 - DNA, 345 bp, Artificial
  MsCOMT deletion introduced by TALEN pair MsCOMT_T01.1
tctcacaaaaacctcatcaatcacaaccatgggttcaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9253 - DNA, 345 bp, Artificial
  MsCOMT deletion introduced by TALEN pair MsCOMT_T01.1
tctcacaaaaacctcatcaatcacaaccatgggttcaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 9254 - DNA, 345 bp, Artificial
  MsCOMT deletion introduced by TALEN pair MsCOMT_T01.1
tctcacaaaaacctcatcaatcacaaccatgggttcaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9255 - DNA, 345 bp, Artificial
  MsCOMT deletion introduced by TALEN pair MsCOMT_T01.1
tctcacaaaaacctcatcaatcacaaccatgggttcaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9256 - DNA, 345 bp, Artificial
  MsCOMT deletion introduced by TALEN pair MsCOMT_T01.1
tctcacaaaaacctcatcaatcacaaccatgggttcaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9257 - DNA, 345 bp, Artificial
  MsCOMT deletion introduced by TALEN pair MsCOMT_T01.1
tctcacaaaaacctcatcaatcacaaccatgggttcaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 9258 - DNA, 345 bp, Artificial
  MsCOMT deletion introduced by TALEN pair MsCOMT_T01.1
tctcacaaaaacctcatcaatcacaaccatgggttcaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatacaccagttatgttggaccgaatgttgcgtctcttggcttgttacaatatcctcacttgttcagttcgtactcaacaagatggaaagattcagagactttatggtttggctactgttgctaa

SEQ ID NO: 9259 - DNA, 345 bp, Artificial
  MsCOMT deletion introduced by TALEN pair MsCOMT_T01.1
tctcacaaaaacctcatcaatcacaaccatgggttcaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9260 - DNA, 345 bp, Artificial
  MsCOMT deletion introduced by TALEN pair MsCOMT_T01.1
tctcacaaaaacctcatcaatcacaaccatgggttcaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9261 - DNA, 345 bp, Artificial
  MsCOMT deletion introduced by TALEN pair MsCOMT_T01.1
tctcacaaaaacctcatcaatcacaaccatgggttcaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccccgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9262 - DNA, 345 bp, Artificial
  MsCOMT deletion introduced by TALEN pair MsCOMT_T01.1
tctcacaaaaacctcatcaatcacaaccatgggttcaacaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 9263 - DNA, 345 bp, Artificial
  MsCOMT deletion introduced by TALEN pair MsCOMT_T01.1
tctcacaaaaacctcatcaatcacaaccatgggttcaacaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9264 - DNA, 345 bp, Artificial
  MsCOMT deletion introduced by TALEN pair MsCOMT_T01.1
tctcacaaaaacctcatcaatcacaaccatgggttcaacaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9265 - DNA, 345 bp, Artificial
  MsCOMT deletion introduced by TALEN pair MsCOMT_T01.1
tctcacaaaaacctcatcaatcacaaccatgggttcaacaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9266 - DNA, 345 bp, Artificial
  MsCOMT deletion introduced by TALEN pair MsCOMT_T01.1
tctcacaaaaacctcatcaatcacaaccatgggttcaacaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9267 - DNA, 345 bp, Artificial
  MsCOMT deletion introduced by TALEN pair MsCOMT_T01.1
tctcacaaaaacctcatcaatcacaaccatgggttcaacaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9268 - DNA, 345 bp, Artificial
  MsCOMT deletion introduced by TALEN pair MsCOMT_T01.1
tctcacaaaaacctcatcaatcacaaccatgggttcaacaacccacatatcagatgaagaagcaaacctcttcgccatgcaactagcaagtgcttcagttcttcccatgattctgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9269 - DNA, 345 bp, Artificial
  MsCOMT deletion introduced by TALEN pair MsCOMT_T01.1
tctcacaaaaacctcatcaatcacaaccatgggttcaacaacccacatatcagatgaagaagcaaacctcttcgccatgcaactagcaagggcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9270 - DNA, 345 bp, Artificial
  MsCOMT deletion introduced by TALEN pair MsCOMT_T01.1
tctcacaaaaacctcatcaatcacaaccatgggttcaacaacccacatatcagatgaagaagcaaacctcttcgccatgcaactagcaagcgcttcagttcttcccatgattttgaaatcagctcttgaacttgatctcttagaaatcattgctaaagctggacccggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9271 - DNA, 344 bp, Artificial
  MsCOMT deletion introduced by TALEN pair MsCOMT_T01.1
tctcacaaaaacctcatcaatcacaaccatgggttcaacaacccacatatcagatgaagaagcaaacctcttcgccatacaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgtgctaa

SEQ ID NO: 9272 - DNA, 345 bp, Artificial
  MsCOMT deletion introduced by TALEN pair MsCOMT_T01.1
tctcacaaaaacctcatcaatcacaaccatgggttcaacaacccacatatcagatgaagaagcaaacctctccgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9273 - DNA, 345 bp, Artificial
  MsCOMT deletion introduced by TALEN pair MsCOMT_T01.1
tctcacaaaaacctcatcaatcacaaccatgggttcaacaacccacatatcagatgaacaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9274 - DNA, 345 bp, Artificial
  MsCOMT deletion introduced by TALEN pair MsCOMT_T01.1
tctcacaaaaacctcatcaatcacaaccatgggttcaacaacccacatatcaaatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9275 - DNA, 343 bp, Artificial
  MsCOMT deletion introduced by TALEN pair MsCOMT_T01.1
tctcacaaaaacctcatcaatcacaaccatgggttcaaacccccatatccgatgaagaagcaaacctcttcgccatgcaattcgcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9276 - DNA, 340 bp, Artificial
  MsCOMT deletion introduced by TALEN pair MsCOMT_T01.1
tctcacaaaaacctcatcaatcacaaccatgggttcaaacccccatatccgatgaagaagcaaacctcttcgccatgcaactcgcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtacgcaacaagatggaaagattcagagactttatggtttggctactgttaa

SEQ ID NO: 9277 - DNA, 343 bp, Artificial
  MsCOMT deletion introduced by TALEN pair MsCOMT_T01.1
tctcacaaaaacctcatcaatcacaaccatgggttcaaacccccatatcagatgaagaagcaaacctcttcgccatgcaattcgcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9278 - DNA, 343 bp, Artificial
  MsCOMT deletion introduced by TALEN pair MsCOMT_T01.1
tctcacaaaaacctcatcaatcacaaccatgggttcaaacccccatatcagatgaagaagcaaacctcttcgccatgcaattcgcaagtgcttcagttcttcccatgattttgaaatcagctcttgaacttgatctcttagaaatcattgctaaagctggacctggtcctcaaatttcacctattgaaattgcttctcagctaccaacaactaaccctgatgcaccagttatgttggaccgaatgttgcgtctcttggcttgttacaatatcctcacttgttcagttcgtactcaacaatatggaaaagttcagagactttatggtttggctactgttgctaa

SEQ ID NO: 9279 - DNA, 343 bp, Artificial
  MsCOMT deletion introduced by TALEN pair MsCOMT_T01.1
tctcacaaaaacctcatcaatcacaaccatgggttcaaacccccatatcagatgaagaagcaaacctcttcgccatgcaattcgcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 9280 - DNA, 343 bp, Artificial
  MsCOMT deletion introduced by TALEN pair MsCOMT_T01.1
tctcacaaaaacctcatcaatcacaaccatgggttcaaacccccatatcagatgaagaagcaaacctcttcgccatgcaattcgcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9281 - DNA, 343 bp, Artificial
  MsCOMT deletion introduced by TALEN pair MsCOMT_T01.1
tctcacaaaaacctcatcaatcacaaccatgggttcaaacccccatatcagatgaagaagcaaacctcttcgccatgcaattcgcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9282 - DNA, 343 bp, Artificial
  MsCOMT deletion introduced by TALEN pair MsCOMT_T01.1
tctcacaaaaacctcatcaatcacaaccatgggttcaaacccccatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 9283 - DNA, 343 bp, Artificial
  MsCOMT deletion introduced by TALEN pair MsCOMT_T01.1
tctcacaaaaacctcatcaatcacaaccatgggttcaaacccccatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 9284 - DNA, 343 bp, Artificial
  MsCOMT deletion introduced by TALEN pair MsCOMT_T01.1
tctcacaaaaacctcatcaatcacaaccatgggttcaaacccccatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 9285 - DNA, 343 bp, Artificial
  MsCOMT deletion introduced by TALEN pair MsCOMT_T01.1
tctcacaaaaacctcatcaatcacaaccatgggttcaaacccccatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9286 - DNA, 343 bp, Artificial
  MsCOMT deletion introduced by TALEN pair MsCOMT_T01.1
tctcacaaaaacctcatcaatcacaaccatgggttcaaacccccatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9287 - DNA, 343 bp, Artificial
  MsCOMT deletion introduced by TALEN pair MsCOMT_T01.1
tctcacaaaaacctcatcaatcacaaccatgggttcaaacccccatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9288 - DNA, 343 bp, Artificial
  MsCOMT deletion introduced by TALEN pair MsCOMT_T01.1
tctcacaaaaacctcatcaatcacaaccatgggttcaaacccccatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9289 - DNA, 343 bp, Artificial
  MsCOMT deletion introduced by TALEN pair MsCOMT_T01.1
tctcacaaaaacctcatcaatcacaaccatgggttcaaacccccatatcagatgaagaagcaaacctcttcgccatgcaactcgcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9290 - DNA, 343 bp, Artificial
  MsCOMT deletion introduced by TALEN pair MsCOMT_T01.1
tctcacaaaaacctcatcaatcacaaccatgggttcaaacccccatatcagatgaagaagcaaacctcttcgccatgcaactcgcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9291 - DNA, 343 bp, Artificial
  MsCOMT deletion introduced by TALEN pair MsCOMT_T01.1
tctcacaaaaacctcatcaatcacaaccatgggttcaaacccccatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatcgtttggccactgttgctaa

SEQ ID NO: 9292 - DNA, 343 bp, Artificial
  MsCOMT deletion introduced by TALEN pair MsCOMT_T01.1
tctcacaaaaacctcatcaatcacaaccatgggttcaaacccccatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagacggaaaggttcagagactttatgggttggctactgttgctaa

SEQ ID NO: 9293 - DNA, 343 bp, Artificial
  MsCOMT deletion introduced by TALEN pair MsCOMT_T01.1
tctcacaaaaacctcatcaatcacaaccatgggttcaaacccccatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcactcgttcagttcgtactcaacaagatggaaaagttcagagactttatggtttggctactgttgctaa

SEQ ID NO: 9294 - DNA, 343 bp, Artificial
  MsCOMT deletion introduced by TALEN pair MsCOMT_T01.1
tctcacaaaaacctcatcaatcacaaccatgggttcaaacccccatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9295 - DNA, 343 bp, Artificial
  MsCOMT deletion introduced by TALEN pair MsCOMT_T01.1
tctcacaaaaacctcatcaatcacaaccatgggttcaaacccccatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9296 - DNA, 343 bp, Artificial
  MsCOMT deletion introduced by TALEN pair MsCOMT_T01.1
tctcacaaaaacctcatcaatcacaaccatgggttcaaacccacatatccgatgaagaagcaaacctcttcgccatgcaattcgcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9297 - DNA, 343 bp, Artificial
  MsCOMT deletion introduced by TALEN pair MsCOMT_T01.1
tctcacaaaaacctcatcaatcacaaccatgggttcaaacccacatatccgatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagcctttatggtttggctactgttgctaa

SEQ ID NO: 9298 - DNA, 343 bp, Artificial
  MsCOMT deletion introduced by TALEN pair MsCOMT_T01.1
tctcacaaaaacctcatcaatcacaaccatgggttcaaacccacatatcagatgaagaagctaacctcttcgccatgcaattcgcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9299 - DNA, 343 bp, Artificial
  MsCOMT deletion introduced by TALEN pair MsCOMT_T01.1
tctcacaaaaacctcatcaatcacaaccatgggttcaaacccacatatcagatgaagaagcagacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9300 - DNA, 343 bp, Artificial
  MsCOMT deletion introduced by TALEN pair MsCOMT_T01.1
tctcacaaaaacctcatcaatcacaaccatgggttcaaacccacatatcagatgaagaagcaaccctcttcgccatgcaattagcaagtgcttcagttcttcccatgcttttacaatcagcccttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 9301 - DNA, 343 bp, Artificial
  MsCOMT deletion introduced by TALEN pair MsCOMT_T01.1
tctcacaaaaacctcatcaatcacaaccatgggttcaaacccacatatcagatgaagaagcaaacctcttcgccatgtaattcgcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9302 - DNA, 343 bp, Artificial
  MsCOMT deletion introduced by TALEN pair MsCOMT_T01.1
tctcacaaaaacctcatcaatcacaaccatgggttcaaacccacatatcagatgaagaagcaaacctcttcgccatgcaattcgcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9303 - DNA, 343 bp, Artificial
  MsCOMT deletion introduced by TALEN pair MsCOMT_T01.1
tctcacaaaaacctcatcaatcacaaccatgggttcaaacccacatatcagatgaagaagcaaacctcttcgccatgcaattcgcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9304 - DNA, 343 bp, Artificial
  MsCOMT deletion introduced by TALEN pair MsCOMT_T01.1
tctcacaaaaacctcatcaatcacaaccatgggttcaaacccacatatcagatgaagaagcaaacctcttcgccatgcaattcgcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 9305 - DNA, 343 bp, Artificial
  MsCOMT deletion introduced by TALEN pair MsCOMT_T01.1
tctcacaaaaacctcatcaatcacaaccatgggttcaaacccacatatcagatgaagaagcaaacctcttcgccatgcaattcgcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9306 - DNA, 343 bp, Artificial
  MsCOMT deletion introduced by TALEN pair MsCOMT_T01.1
tctcacaaaaacctcatcaatcacaaccatgggttcaaacccacatatcagatgaagaagcaaacctcttcgccatgcaattcgcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9307 - DNA, 343 bp, Artificial
  MsCOMT deletion introduced by TALEN pair MsCOMT_T01.1
tctcacaaaaacctcatcaatcacaaccatgggttcaaacccacatatcagatgaagaagcaaacctcttcgccatgcaattcgcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9308 - DNA, 343 bp, Artificial
  MsCOMT deletion introduced by TALEN pair MsCOMT_T01.1
tctcacaaaaacctcatcaatcacaaccatgggttcaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9309 - DNA, 343 bp, Artificial
  MsCOMT deletion introduced by TALEN pair MsCOMT_T01.1
tctcacaaaaacctcatcaatcacaaccatgggttcaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9310 - DNA, 342 bp, Artificial
  MsCOMT deletion introduced by TALEN pair MsCOMT_T01.1
tctcacaaaaacctcatcaatcacaaccatgggttcaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctctgggctggttacaatatcctcactgttcagttcgtactcaacaagatggaaaggttcagagactttatggtttggctactgttgctaa

SEQ ID NO: 9311 - DNA, 343 bp, Artificial
  MsCOMT deletion introduced by TALEN pair MsCOMT_T01.1
tctcacaaaaacctcatcaatcacaaccatgggttcaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9312 - DNA, 343 bp, Artificial
  MsCOMT deletion introduced by TALEN pair MsCOMT_T01.1
tctcacaaaaacctcatcaatcacaaccatgggttcaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 9313 - DNA, 343 bp, Artificial
  MsCOMT deletion introduced by TALEN pair MsCOMT_T01.1
tctcacaaaaacctcatcaatcacaaccatgggttcaaacccacatatcagatgaagaagcaaacctcttcgccatgcaattagcaagtgcttcagttcttcccatgattttgaaatcagctcttgaacttgatctctcagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9314 - DNA, 343 bp, Artificial
  MsCOMT deletion introduced by TALEN pair MsCOMT_T01.1
tctcacaaaaacctcatcaatcacaaccatgggttcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcatctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 9315 - DNA, 343 bp, Artificial
  MsCOMT deletion introduced by TALEN pair MsCOMT_T01.1
tctcacaaaaacctcatcaatcacaaccatgggttcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 9316 - DNA, 343 bp, Artificial
  MsCOMT deletion introduced by TALEN pair MsCOMT_T01.1
tctcacaaaaacctcatcaatcacaaccatgggttcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 9317 - DNA, 343 bp, Artificial
  MsCOMT deletion introduced by TALEN pair MsCOMT_T01.1
tctcacaaaaacctcatcaatcacaaccatgggttcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 9318 - DNA, 343 bp, Artificial
  MsCOMT deletion introduced by TALEN pair MsCOMT_T01.1
tctcacaaaaacctcatcaatcacaaccatgggttcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 9319 - DNA, 343 bp, Artificial
  MsCOMT deletion introduced by TALEN pair MsCOMT_T01.1
tctcacaaaaacctcatcaatcacaaccatgggttcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9320 - DNA, 343 bp, Artificial
  MsCOMT deletion introduced by TALEN pair MsCOMT_T01.1
tctcacaaaaacctcatcaatcacaaccatgggttcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9321 - DNA, 343 bp, Artificial
  MsCOMT deletion introduced by TALEN pair MsCOMT_T01.1
tctcacaaaaacctcatcaatcacaaccatgggttcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9322 - DNA, 343 bp, Artificial
  MsCOMT deletion introduced by TALEN pair MsCOMT_T01.1
tctcacaaaaacctcatcaatcacaaccatgggttcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggctcgttacaatatcctcacttgttcagttcgtactcaacaagatggaaagattcagagactttatggtttggctactgttgctaa

SEQ ID NO: 9323 - DNA, 343 bp, Artificial
  MsCOMT deletion introduced by TALEN pair MsCOMT_T01.1
tctcacaaaaacctcatcaatcacaaccatgggttcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9324 - DNA, 343 bp, Artificial
  MsCOMT deletion introduced by TALEN pair MsCOMT_T01.1
tctcacaaaaacctcatcaatcacaaccatgggttcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9325 - DNA, 343 bp, Artificial
  MsCOMT deletion introduced by TALEN pair MsCOMT_T01.1
tctcacaaaaacctcatcaatcacaaccatgggttcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 9326 - DNA, 342 bp, Artificial
  MsCOMT deletion introduced by TALEN pair MsCOMT_T01.1
tctcacaaaaacctcatcaatcacaaccatgggttcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgcta

SEQ ID NO: 9327 - DNA, 343 bp, Artificial
  MsCOMT deletion introduced by TALEN pair MsCOMT_T01.1
tctcacaaaaacctcatcaatcacaaccatgggttcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttgacttgttacaatatcctcacttgttcagttcgtactcaacaagatggaaagattcagagactttatggtttggctactgttgctaa

SEQ ID NO: 9328 - DNA, 343 bp, Artificial
  MsCOMT deletion introduced by TALEN pair MsCOMT_T01.1
tctcacaaaaacctcatcaatcacaaccatgggttcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9329 - DNA, 343 bp, Artificial
  MsCOMT deletion introduced by TALEN pair MsCOMT_T01.1
tctcacaaaaacctcatcaatcacaaccatgggttcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtcacttggcttgttacaatatcctcacttgttcagttcgtactcaacaagatggaaaggttcagagactttatggtttggctactgttgctaa

SEQ ID NO: 9330 - DNA, 343 bp, Artificial
  MsCOMT deletion introduced by TALEN pair MsCOMT_T01.1
tctcacaaaaacctcatcaatcacaaccatgggttcaaacccacatatcagatgaagaagcaaacctcttcgccatgcaattagcaagtgcttcagttcttcccatgattttaaaatcagctcttgaacttgatctcttagaaatcattgctaaagctggacctggtactcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 9331 - DNA, 343 bp, Artificial
  MsCOMT deletion introduced by TALEN pair MsCOMT_T01.1
tctcacaaaaacctcatcaatcacaaccatgggttcaaacccacatatcagatgaagaagcaaacctcttcgccatgcaactcgcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9332 - DNA, 343 bp, Artificial
  MsCOMT deletion introduced by TALEN pair MsCOMT_T01.1
tctcacaaaaacctcatcaatcacaaccatgggttcaaacccacatatcagatgaagaagcaaacctcttcgccatgcaactcgcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 9333 - DNA, 343 bp, Artificial
  MsCOMT deletion introduced by TALEN pair MsCOMT_T01.1
tctcacaaaaacctcatcaatcacaaccatgggttcaaacccacatatcagatgaagaagcaaacctcttcgccatgcaactcgcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9334 - DNA, 343 bp, Artificial
  MsCOMT deletion introduced by TALEN pair MsCOMT_T01.1
tctcacaaaaacctcatcaatcacaaccatgggttcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9335 - DNA, 343 bp, Artificial
  MsCOMT deletion introduced by TALEN pair MsCOMT_T01.1
tctcacaaaaacctcatcaatcacaaccatgggttcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9336 - DNA, 343 bp, Artificial
  MsCOMT deletion introduced by TALEN pair MsCOMT_T01.1
tctcacaaaaacctcatcaatcacaaccatgggttcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 9337 - DNA, 343 bp, Artificial
  MsCOMT deletion introduced by TALEN pair MsCOMT_T01.1
tctcacaaaaacctcatcaatcacaaccatgggttcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9338 - DNA, 343 bp, Artificial
  MsCOMT deletion introduced by TALEN pair MsCOMT_T01.1
tctcacaaaaacctcatcaatcacaaccatgggttcaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9339 - DNA, 343 bp, Artificial
  MsCOMT deletion introduced by TALEN pair MsCOMT_T01.1
tctcacaaaaacctcatcaatcacaaccatgggttcaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9340 - DNA, 343 bp, Artificial
  MsCOMT deletion introduced by TALEN pair MsCOMT_T01.1
tctcacaaaaacctcatcaatcacaaccatgggttcaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactagccctgatgcaccagttatgttggaccgaatgttgcgtatcttggcttgttacaatatcctcacttgttcagttcgtactcaacaagatggaaaggttcagagactttatggtttggctactgttgctaa

SEQ ID NO: 9341 - DNA, 343 bp, Artificial
  MsCOMT deletion introduced by TALEN pair MsCOMT_T01.1
tctcacaaaaacctcatcaatcacaaccatgggttcaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9342 - DNA, 343 bp, Artificial
  MsCOMT deletion introduced by TALEN pair MsCOMT_T01.1
tctcacaaaaacctcatcaatcacaaccatgggttcaaacccacatatcagatgaagaagcaaacctcttcgacatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9343 - DNA, 356 bp, Artificial
  MsCOMT deletion introduced by TALEN pair MsCOMT_T01.1
tctcacaaaaacctcatcaatcacaaccatgggttcaaaaggtgaaatccaacccacatatcagatgaagaagcaaacctcttcgccatgtaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9344 - DNA, 361 bp, Artificial
  MsCOMT deletion introduced by TALEN pair MsCOMT_T01.1
tctcacaaaaacctcatcaatcacaaccatgggttcaaaaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggacctggtgcccaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9345 - DNA, 360 bp, Artificial
  MsCOMT deletion introduced by TALEN pair MsCOMT_T01.1
tctcacaaaaacctcatcaatcacaaccatgggttcaaaaggtgaaactcaaataacccacatatcagatgaagaagcaaacctcttcgccatgcaattagcaagtgcttcagttcttcccatgattttaaaatcagctcctgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9346 - DNA, 360 bp, Artificial
  MsCOMT deletion introduced by TALEN pair MsCOMT_T01.1
tctcacaaaaacctcatcaatcacaaccatgggttcaaaaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9347 - DNA, 360 bp, Artificial
  MsCOMT deletion introduced by TALEN pair MsCOMT_T01.1
tctcacaaaaacctcatcaatcacaaccatgggttaacaggtgaaactcaaaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9348 - DNA, 352 bp, Artificial
  MsCOMT deletion introduced by TALEN pair MsCOMT_T01.1
tctcacaaaaacctcatcaatcacaaccatgggttaaacaggtgaaaacccacctatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9349 - DNA, 359 bp, Artificial
  MsCOMT deletion introduced by TALEN pair MsCOMT_T01.1
tctcacaaaaacctcatcaatcacaaccatgggtccaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9350 - DNA, 360 bp, Artificial
  MsCOMT deletion introduced by TALEN pair MsCOMT_T01.1
tctcacaaaaacctcatcaatcacaaccatgggtccaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9351 - DNA, 364 bp, Artificial
  MsCOMT deletion introduced by TALEN pair MsCOMT_T01.1
tctcacaaaaacctcatcaatcacaaccatgggtccaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9352 - DNA, 356 bp, Artificial
  MsCOMT deletion introduced by TALEN pair MsCOMT_T01.1
tctcacaaaaacctcatcaatcacaaccatgggtccaacaggtgaaactcaaataacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9353 - DNA, 363 bp, Artificial
  MsCOMT deletion introduced by TALEN pair MsCOMT_T01.1
tctcacaaaaacctcatcaatcacaaccatgggtccaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9354 - DNA, 361 bp, Artificial
  MsCOMT deletion introduced by TALEN pair MsCOMT_T01.1
tctcacaaaaacctcatcaatcacaaccatgggtccaacaggtgaaactcaaataaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9355 - DNA, 361 bp, Artificial
  MsCOMT deletion introduced by TALEN pair MsCOMT_T01.1
tctcacaaaaacctcatcaatcacaaccatgggtccaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9356 - DNA, 362 bp, Artificial
  MsCOMT deletion introduced by TALEN pair MsCOMT_T01.1
tctcacaaaaacctcatcaatcacaaccatgggtccaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 9357 - DNA, 357 bp, Artificial
  MsCOMT deletion introduced by TALEN pair MsCOMT_T01.1
tctcacaaaaacctcatcaatcacaaccatgggtccaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9358 - DNA, 358 bp, Artificial
  MsCOMT deletion introduced by TALEN pair MsCOMT_T01.1
tctcacaaaaacctcatcaatcacaaccatgggtccaacaggtgaaactcaaaacccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 9359 - DNA, 346 bp, Artificial
  MsCOMT deletion introduced by TALEN pair MsCOMT_T01.1
tctcacaaaaacctcatcaatcacaaccatgggtccaacaggtgaaactatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9360 - DNA, 350 bp, Artificial
  MsCOMT deletion introduced by TALEN pair MsCOMT_T01.1
tctcacaaaaacctcatcaatcacaaccatgggtcaacaggtgaaactcaaatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9361 - DNA, 359 bp, Artificial
  MsCOMT deletion introduced by TALEN pair MsCOMT_T01.1
tctcacaaaaacctcatcaatcacaaccatgggtcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 9362 - DNA, 359 bp, Artificial
  MsCOMT deletion introduced by TALEN pair MsCOMT_T01.1
tctcacaaaaacctcatcaatcacaaccatgggtcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9363 - DNA, 356 bp, Artificial
  MsCOMT deletion introduced by TALEN pair MsCOMT_T01.1
tctcacaaaaacctcatcaatcacaaccatgggtcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9364 - DNA, 357 bp, Artificial
  MsCOMT deletion introduced by TALEN pair MsCOMT_T01.1
tctcacaaaaacctcatcaatcacaaccatgggtcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9365 - DNA, 359 bp, Artificial
  MsCOMT deletion introduced by TALEN pair MsCOMT_T01.1
tctcacaaaaacctcatcaatcacaaccatgggtcaacaggggaaaatccaaaaacccacataacagatgaaaaaacaaacctcttcgccaagcaaataagaaaggcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9366 - DNA, 344 bp, Artificial
  MsCOMT deletion introduced by TALEN pair MsCOMT_T01.1
tctcacaaaaacctcatcaatcacaaccatggggtcaacacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtcgcttggcttgttacaatatcctcacttgttctgttcgtactcaacaagatggaaaggttcagagactttatggtttggctactgttgataa

SEQ ID NO: 9367 - DNA, 333 bp, Artificial
  MsCOMT deletion introduced by TALEN pair MsCOMT_T01.1
tctcacaaaaacctcatcaatcacaaccatgggctcaacaggtgaagaagcaaacctcttcgccatgcaactaccaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatattgcgtctgttggcttgttacaatatcctcacttgttcagttcgtactcaagaagatggaaaggttcagagactttatggtttggctactgttgctaa

SEQ ID NO: 9368 - DNA, 352 bp, Artificial
  MsCOMT deletion introduced by TALEN pair MsCOMT_T01.1
tctcacaaaaacctcatcaatcacaaccatgggctcaacaggtgaaactccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9369 - DNA, 352 bp, Artificial
  MsCOMT deletion introduced by TALEN pair MsCOMT_T01.1
tctcacaaaaacctcatcaatcacaaccatgggctcaacaggtgaaactccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9370 - DNA, 360 bp, Artificial
  MsCOMT deletion introduced by TALEN pair MsCOMT_T01.1
tctcacaaaaacctcatcaatcacaaccatgggctcaacaggtgaaactcaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactagccctggtgcaccagttatgttggaccgaatgtggcgtctcttggattgtgacaatatcctcacttgttcagttcgtactcaacaagatggaaaggttcagagagtttatggtttggctactggtgctaa

SEQ ID NO: 9371 - DNA, 434 bp, Artificial
  MsCOMT deletion introduced by TALEN pair MsCOMT_T01.1
tctcacaaaaacctcatcaatcacaaccatgggctcaacaggtgaaactcaaatggcacagcaccggcaacagccgctggaccgtctccagcgcctgcttgccaccgccattgctggcgatggccaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9372 - DNA, 359 bp, Artificial
  MsCOMT deletion introduced by TALEN pair MsCOMT_T01.1
tctcacaaaaacctcatcaatcacaaccatgggctcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9373 - DNA, 363 bp, Artificial
  MsCOMT deletion introduced by TALEN pair MsCOMT_T01.1
tctcacaaaaacctcatcaatcacaaccatgggctcaacaggtgaaactcaaataccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9374 - DNA, 363 bp, Artificial
  MsCOMT deletion introduced by TALEN pair MsCOMT_T01.1
tctcacaaaaacctcatcaatcacaaccatgggctcaacaggtgaaactcaaataccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9375 - DNA, 363 bp, Artificial
  MsCOMT deletion introduced by TALEN pair MsCOMT_T01.1
tctcacaaaaacctcatcaatcacaaccatgggctcaacaggtgaaactcaaataccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 9376 - DNA, 360 bp, Artificial
  MsCOMT deletion introduced by TALEN pair MsCOMT_T01.1
tctcacaaaaacctcatcaatcacaaccatgggctcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9377 - DNA, 360 bp, Artificial
  MsCOMT deletion introduced by TALEN pair MsCOMT_T01.1
tctcacaaaaacctcatcaatcacaaccatgggctcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9378 - DNA, 360 bp, Artificial
  MsCOMT deletion introduced by TALEN pair MsCOMT_T01.1
tctcacaaaaacctcatcaatcacaaccatgggctcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 9379 - DNA, 392 bp, Artificial
  MsCOMT deletion introduced by TALEN pair MsCOMT_T01.1
tctcacaaaaacctcatcaatcacaaccatgggctcaacaggtgaaactcaaataaccaccgctggtagcggtggtttttttgtttgcacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgcaa

SEQ ID NO: 9380 - DNA, 357 bp, Artificial
  MsCOMT deletion introduced by TALEN pair MsCOMT_T01.1
tctcacaaaaacctcatcaatcacaaccatgggctcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9381 - DNA, 355 bp, Artificial
  MsCOMT deletion introduced by TALEN pair MsCOMT_T01.1
tctcacaaaaacctcatcaatcacaaccatgggctcaacaggtgaaactcaaacacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9382 - DNA, 358 bp, Artificial
  MsCOMT deletion introduced by TALEN pair MsCOMT_T01.1
tctcacaaaaacctcatcaatcacaaccatgggctcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9383 - DNA, 359 bp, Artificial
  MsCOMT deletion introduced by TALEN pair MsCOMT_T01.1
tctcacaaaaacctcatcaatcacaaccatgggatcaacaggtgaaactcaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9384 - DNA, 363 bp, Artificial
  MsCOMT deletion introduced by TALEN pair MsCOMT_T01.1
tctcacaaaaacctcatcaatcacaaccatgggatcaacaggtgaaactcaaataccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9385 - DNA, 357 bp, Artificial
  MsCOMT deletion introduced by TALEN pair MsCOMT_T01.1
tctcacaaaaacctcatcaatcacaaccatgggatcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9386 - DNA, 351 bp, Artificial
  MsCOMT deletion introduced by TALEN pair MsCOMT_T01.1
tctcacaaaaacctcatcaatcacaaccatgggatcaacaggtgaaacccacatatcagatgaagaagcaaacctcttcgccatgcaattagcaagtgcttcagttcttcccatgattttaaaatcagctcttgaacttgatctcttacaaatcattgctaaagctggacctggtgctcaaatttcacctattgaaattgcttctcagctcccaacaactaaccctgatgcaccagttatgttcgaccgaatgttgcgtctcttggcttgttacaatatcctcgcttgttcagttcgtactcaacaagatggaaaagttcagaggctttatggtttggctactgttgctaa

SEQ ID NO: 9387 - DNA, 360 bp, Artificial
  MsCOMT deletion introduced by TALEN pair MsCOMT_T01.1
tctcacaaaaacctcatcaatcacaaccatggcttcaacaggtgaaactcaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9388 - DNA, 363 bp, Artificial
  MsCOMT deletion introduced by TALEN pair MsCOMT_T01.1
tctcacaaaaacctcatcaatcacaaccatggcttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9389 - DNA, 334 bp, Artificial
  MsCOMT deletion introduced by TALEN pair MsCOMT_T01.1
tctcacaaaaacctcatcaatcacaaccatggcacatatcagctgaagacgcacacctcttcgccatacaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9390 - DNA, 334 bp, Artificial
  MsCOMT deletion introduced by TALEN pair MsCOMT_T01.1
tctcacaaaaacctcatcaatcacaaccatggcacatatcagctgaagaagcacacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9391 - DNA, 334 bp, Artificial
  MsCOMT deletion introduced by TALEN pair MsCOMT_T01.1
tctcacaaaaacctcatcaatcacaaccatggcacatatcagctgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9392 - DNA, 335 bp, Artificial
  MsCOMT deletion introduced by TALEN pair MsCOMT_T01.1
tctcacaaaaacctcatcaatcacaaccatggcacatatcagctgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggcttactgttgctaa

SEQ ID NO: 9393 - DNA, 334 bp, Artificial
  MsCOMT deletion introduced by TALEN pair MsCOMT_T01.1
tctcacaaaaacctcatcaatcacaaccatggcacatatcagctgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9394 - DNA, 334 bp, Artificial
  MsCOMT deletion introduced by TALEN pair MsCOMT_T01.1
tctcacaaaaacctcatcaatcacaaccatggcacatatcagctgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 9395 - DNA, 334 bp, Artificial
  MsCOMT deletion introduced by TALEN pair MsCOMT_T01.1
tctcacaaaaacctcatcaatcacaaccatggcacatatcagctgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 9396 - DNA, 334 bp, Artificial
  MsCOMT deletion introduced by TALEN pair MsCOMT_T01.1
tctcacaaaaacctcatcaatcacaaccatggcacatatcagctgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9397 - DNA, 334 bp, Artificial
  MsCOMT deletion introduced by TALEN pair MsCOMT_T01.1
tctcacaaaaacctcatcaatcacaaccatggcacatatcagatgaagaagcacacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 9398 - DNA, 334 bp, Artificial
  MsCOMT deletion introduced by TALEN pair MsCOMT_T01.1
tctcacaaaaacctcatcaatcacaaccatggcacatatcagatgaagaagcacacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9399 - DNA, 334 bp, Artificial
  MsCOMT deletion introduced by TALEN pair MsCOMT_T01.1
tctcacaaaaacctcatcaatcacaaccatggcacatatcagatgaagaagcaaacctcttcgccatgcaattagcaagtgcttcagttcttcccatgattttgaaatcagctcttgaacttgatctcttataaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 9400 - DNA, 335 bp, Artificial
  MsCOMT deletion introduced by TALEN pair MsCOMT_T01.1
tctcacaaaaacctcatcaatcacaaccatggcacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggcctactgttgctaa

SEQ ID NO: 9401 - DNA, 334 bp, Artificial
  MsCOMT deletion introduced by TALEN pair MsCOMT_T01.1
tctcacaaaaacctcatcaatcacaaccatggcacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9402 - DNA, 334 bp, Artificial
  MsCOMT deletion introduced by TALEN pair MsCOMT_T01.1
tctcacaaaaacctcatcaatcacaaccatggcacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9403 - DNA, 334 bp, Artificial
  MsCOMT deletion introduced by TALEN pair MsCOMT_T01.1
tctcacaaaaacctcatcaatcacaaccatggcacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9404 - DNA, 334 bp, Artificial
  MsCOMT deletion introduced by TALEN pair MsCOMT_T01.1
tctcacaaaaacctcatcaatcacaaccatggcacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9405 - DNA, 334 bp, Artificial
  MsCOMT deletion introduced by TALEN pair MsCOMT_T01.1
tctcacaaaaacctcatcaatcacaaccatggcacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9406 - DNA, 334 bp, Artificial
  MsCOMT deletion introduced by TALEN pair MsCOMT_T01.1
tctcacaaaaacctcatcaatcacaaccatggcacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 9407 - DNA, 334 bp, Artificial
  MsCOMT deletion introduced by TALEN pair MsCOMT_T01.1
tctcacaaaaacctcatcaatcacaaccatggcacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9408 - DNA, 334 bp, Artificial
  MsCOMT deletion introduced by TALEN pair MsCOMT_T01.1
tctcacaaaaacctcatcaatcacaaccatggcacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9409 - DNA, 334 bp, Artificial
  MsCOMT deletion introduced by TALEN pair MsCOMT_T01.1
tctcacaaaaacctcatcaatcacaaccatggcacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9410 - DNA, 334 bp, Artificial
  MsCOMT deletion introduced by TALEN pair MsCOMT_T01.1
tctcacaaaaacctcatcaatcacaaccatggcacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 9411 - DNA, 334 bp, Artificial
  MsCOMT deletion introduced by TALEN pair MsCOMT_T01.1
tctcacaaaaacctcatcaatcacaaccatggcacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9412 - DNA, 334 bp, Artificial
  MsCOMT deletion introduced by TALEN pair MsCOMT_T01.1
tctcacaaaaacctcatcaatcacaaccatggcacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9413 - DNA, 334 bp, Artificial
  MsCOMT deletion introduced by TALEN pair MsCOMT_T01.1
tctcacaaaaacctcatcaatcacaaccatggcacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9414 - DNA, 334 bp, Artificial
  MsCOMT deletion introduced by TALEN pair MsCOMT_T01.1
tctcacaaaaacctcatcaatcacaaccatggcacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgtcgcgtctcttggcttgttacaatatcctcacttgttcagttcgtactcaacaagatggaaaggttcagagactttatggtttggctactgttgctaa

SEQ ID NO: 9415 - DNA, 334 bp, Artificial
  MsCOMT deletion introduced by TALEN pair MsCOMT_T01.1
tctcacaaaaacctcatcaatcacaaccatggcacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9416 - DNA, 360 bp, Artificial
  MsCOMT deletion introduced by TALEN pair MsCOMT_T01.1
tctcacaaaaacctcatcaatcacaaccatggattcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9417 - DNA, 361 bp, Artificial
  MsCOMT deletion introduced by TALEN pair MsCOMT_T01.1
tctcacaaaaacctcatcaatcacaaccatggattcaacaggtgaaactcaaataaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9418 - DNA, 357 bp, Artificial
  MsCOMT deletion introduced by TALEN pair MsCOMT_T01.1
tctcacaaaaacctcatcaatcacaaccatggattcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9419 - DNA, 345 bp, Artificial
  MsCOMT deletion introduced by TALEN pair MsCOMT_T01.1
tctcacaaaaacctcatcaatcacaaccatggattcaacaacccacatatcagatgaataagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9420 - DNA, 343 bp, Artificial
  MsCOMT deletion introduced by TALEN pair MsCOMT_T01.1
tctcacaaaaacctcatcaatcacaaccatggattcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 9421 - DNA, 360 bp, Artificial
  MsCOMT deletion introduced by TALEN pair MsCOMT_T01.1
tctcacaaaaacctcatcaatcacaaccatgcgttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9422 - DNA, 360 bp, Artificial
  MsCOMT deletion introduced by TALEN pair MsCOMT_T01.1
tctcacaaaaacctcatcaatcacaaccatgcgttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9423 - DNA, 361 bp, Artificial
  MsCOMT deletion introduced by TALEN pair MsCOMT_T01.1
tctcacaaaaacctcatcaatcacaaccatgagttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9424 - DNA, 364 bp, Artificial
  MsCOMT deletion introduced by TALEN pair MsCOMT_T01.1
tctcacaaaaacctcatcaatcacaaccatcggttcaacaggtgaaactcaaataacaaacccacatatcagatgaagaagcaaacctcttcgccattcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 9425 - DNA, 359 bp, Artificial
  MsCOMT deletion introduced by TALEN pair MsCOMT_T01.1
tctcacaaaaacctcatcaatcacaaccataggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9426 - DNA, 360 bp, Artificial
  MsCOMT deletion introduced by TALEN pair MsCOMT_T01.1
tctcacaaaaacctcatcaatcacaaccataggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9427 - DNA, 360 bp, Artificial
  MsCOMT deletion introduced by TALEN pair MsCOMT_T01.1
tctcacaaaaacctcatcaatcacaaccataggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9428 - DNA, 359 bp, Artificial
  MsCOMT deletion introduced by TALEN pair MsCOMT_T01.1
tctcacaaaaacctcatcaatcacaaccaggggttcaacaggtgaaactcaaataaccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9429 - DNA, 359 bp, Artificial
  MsCOMT deletion introduced by TALEN pair MsCOMT_T01.1
tctcacaaaaacctcatcaatcacaaccacgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9430 - DNA, 334 bp, Artificial
  MsCOMT deletion introduced by TALEN pair MsCOMT_T01.1
tctcacaaaaacctcatcaatcacaaccaaccctcctatcagttgaagacgaaacccatttcgccttgcaaatagcaactctttcagatcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9431 - DNA, 334 bp, Artificial
  MsCOMT deletion introduced by TALEN pair MsCOMT_T01.1
tctcacaaaaacctcatcaatcacaaccaacccacatatcagctgaagacgcacacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9432 - DNA, 334 bp, Artificial
  MsCOMT deletion introduced by TALEN pair MsCOMT_T01.1
tctcacaaaaacctcatcaatcacaaccaacccacatatcagctgaagacgcacacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9433 - DNA, 334 bp, Artificial
  MsCOMT deletion introduced by TALEN pair MsCOMT_T01.1
tctcacaaaaacctcatcaatcacaaccaacccacatatcagctgaagaagcacacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcatctcttggcttgttacaatatcctcacttgttctgttcgtactcaacaagatggaaaggttcagagactttatggtttggctactgttgcaaa

SEQ ID NO: 9434 - DNA, 334 bp, Artificial
  MsCOMT deletion introduced by TALEN pair MsCOMT_T01.1
tctcacaaaaacctcatcaatcacaaccaacccacatatcagctgaagaagcacacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggatcgaatgttgcgtctcttggcttgttacaatatcctcacttgttcagttcgtactcaacaagatggaaaggttcagagactttatggtttggctactgttgctaa

SEQ ID NO: 9435 - DNA, 334 bp, Artificial
  MsCOMT deletion introduced by TALEN pair MsCOMT_T01.1
tctcacaaaaacctcatcaatcacaaccaacccacatatcagctgaagaagcacacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9436 - DNA, 334 bp, Artificial
  MsCOMT deletion introduced by TALEN pair MsCOMT_T01.1
tctcacaaaaacctcatcaatcacaaccaacccacatatcagctgaagaagcacacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9437 - DNA, 334 bp, Artificial
  MsCOMT deletion introduced by TALEN pair MsCOMT_T01.1
tctcacaaaaacctcatcaatcacaaccaacccacatatcagctgaagaagcacacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9438 - DNA, 334 bp, Artificial
  MsCOMT deletion introduced by TALEN pair MsCOMT_T01.1
tctcacaaaaacctcatcaatcacaaccaacccacatatcagctgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 9439 - DNA, 334 bp, Artificial
  MsCOMT deletion introduced by TALEN pair MsCOMT_T01.1
tctcacaaaaacctcatcaatcacaaccaacccacatatcagctgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 9440 - DNA, 334 bp, Artificial
  MsCOMT deletion introduced by TALEN pair MsCOMT_T01.1
tctcacaaaaacctcatcaatcacaaccaacccacatatcagctgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9441 - DNA, 334 bp, Artificial
  MsCOMT deletion introduced by TALEN pair MsCOMT_T01.1
tctcacaaaaacctcatcaatcacaaccaacccacatatcagctgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9442 - DNA, 334 bp, Artificial
  MsCOMT deletion introduced by TALEN pair MsCOMT_T01.1
tctcacaaaaacctcatcaatcacaaccaacccacatatcagctgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9443 - DNA, 334 bp, Artificial
  MsCOMT deletion introduced by TALEN pair MsCOMT_T01.1
tctcacaaaaacctcatcaatcacaaccaacccacatatcagatgaagaagcacacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9444 - DNA, 334 bp, Artificial
  MsCOMT deletion introduced by TALEN pair MsCOMT_T01.1
tctcacaaaaacctcatcaatcacaaccaacccacatatcagatgaagaagcacacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgcgaa

SEQ ID NO: 9445 - DNA, 334 bp, Artificial
  MsCOMT deletion introduced by TALEN pair MsCOMT_T01.1
tctcacaaaaacctcatcaatcacaaccaacccacatatcagatgaagaagcaaacctcttctccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9446 - DNA, 334 bp, Artificial
  MsCOMT deletion introduced by TALEN pair MsCOMT_T01.1
tctcacaaaaacctcatcaatcacaaccaacccacatatcagatgaagaagcaaacctcttcgccttgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9447 - DNA, 334 bp, Artificial
  MsCOMT deletion introduced by TALEN pair MsCOMT_T01.1
tctcacaaaaacctcatcaatcacaaccaacccacatatcagatgaagaagcaaacctcttcgccatgcaattagcaagtgcttcagttcttcccatgattttgaaatcagctcttgaacttgatctcttggaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9448 - DNA, 334 bp, Artificial
  MsCOMT deletion introduced by TALEN pair MsCOMT_T01.1
tctcacaaaaacctcatcaatcacaaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcactcgttcagttcgtactcaacaagatggaaaggttcagagactttatggtttggctactgttgctaa

SEQ ID NO: 9449 - DNA, 334 bp, Artificial
  MsCOMT deletion introduced by TALEN pair MsCOMT_T01.1
tctcacaaaaacctcatcaatcacaaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9450 - DNA, 334 bp, Artificial
  MsCOMT deletion introduced by TALEN pair MsCOMT_T01.1
tctcacaaaaacctcatcaatcacaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 9451 - DNA, 334 bp, Artificial
  MsCOMT deletion introduced by TALEN pair MsCOMT_T01.1
tctcacaaaaacctcatcaatcacaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9452 - DNA, 334 bp, Artificial
  MsCOMT deletion introduced by TALEN pair MsCOMT_T01.1
tctcacaaaaacctcatcaatcacaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 9453 - DNA, 334 bp, Artificial
  MsCOMT deletion introduced by TALEN pair MsCOMT_T01.1
tctcacaaaaacctcatcaatcacaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9454 - DNA, 334 bp, Artificial
  MsCOMT deletion introduced by TALEN pair MsCOMT_T01.1
tctcacaaaaacctcatcaatcacaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9455 - DNA, 334 bp, Artificial
  MsCOMT deletion introduced by TALEN pair MsCOMT_T01.1
tctcacaaaaacctcatcaatcacaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 9456 - DNA, 334 bp, Artificial
  MsCOMT deletion introduced by TALEN pair MsCOMT_T01.1
tctcacaaaaacctcatcaatcacaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9457 - DNA, 334 bp, Artificial
  MsCOMT deletion introduced by TALEN pair MsCOMT_T01.1
tctcacaaaaacctcatcaatcacaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9458 - DNA, 333 bp, Artificial
  MsCOMT deletion introduced by TALEN pair MsCOMT_T01.1
tctcacaaaaacctcatcaatcacaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgtgctaa

SEQ ID NO: 9459 - DNA, 334 bp, Artificial
  MsCOMT deletion introduced by TALEN pair MsCOMT_T01.1
tctcacaaaaacctcatcaatcacaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggctagttacaatatcctcacttgttcagttcgtactcatcaagatggaaaggttcagagactttatggtttggctactggtgctaa

SEQ ID NO: 9460 - DNA, 334 bp, Artificial
  MsCOMT deletion introduced by TALEN pair MsCOMT_T01.1
tctcacaaaaacctcatcaatcacaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9461 - DNA, 334 bp, Artificial
  MsCOMT deletion introduced by TALEN pair MsCOMT_T01.1
tctcacaaaaacctcatcaatcacaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9462 - DNA, 334 bp, Artificial
  MsCOMT deletion introduced by TALEN pair MsCOMT_T01.1
tctcacaaaaacctcatcaatcacaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9463 - DNA, 334 bp, Artificial
  MsCOMT deletion introduced by TALEN pair MsCOMT_T01.1
tctcacaaaaacctcatcaatcacaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 9464 - DNA, 334 bp, Artificial
  MsCOMT deletion introduced by TALEN pair MsCOMT_T01.1
tctcacaaaaacctcatcaatcacaaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9465 - DNA, 334 bp, Artificial
  MsCOMT deletion introduced by TALEN pair MsCOMT_T01.1
tctcacaaaaacctcatcaatcacaaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9466 - DNA, 312 bp, Artificial
  MsCOMT deletion introduced by TALEN pair MsCOMT_T01.1
tctcacaaaaacctcatcaatcacaacagcaaacctcttcgccttgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9467 - DNA, 312 bp, Artificial
  MsCOMT deletion introduced by TALEN pair MsCOMT_T01.1
tctcacaaaaacctcatcaatcacaacagcaaacctcttcgccatgcaattagcaagttcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 9468 - DNA, 312 bp, Artificial
  MsCOMT deletion introduced by TALEN pair MsCOMT_T01.1
tctcacaaaaacctcatcaatcacaacagcaaacctcttcgccatgcaattagcaagttcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9469 - DNA, 312 bp, Artificial
  MsCOMT deletion introduced by TALEN pair MsCOMT_T01.1
tctcacaaaaacctcatcaatcacaacagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9470 - DNA, 312 bp, Artificial
  MsCOMT deletion introduced by TALEN pair MsCOMT_T01.1
tctcacaaaaacctcatcaatcacaacagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9471 - DNA, 312 bp, Artificial
  MsCOMT deletion introduced by TALEN pair MsCOMT_T01.1
tctcacaaaaacctcatcaatcacaacagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9472 - DNA, 312 bp, Artificial
  MsCOMT deletion introduced by TALEN pair MsCOMT_T01.1
tctcacaaaaacctcatcaatcacaacagcaaacctcttcgccatgcaactagcaagttcttcagttcttcccatgattttgcaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9473 - DNA, 312 bp, Artificial
  MsCOMT deletion introduced by TALEN pair MsCOMT_T01.1
tctcacaaaaacctcatcaatcacaacagcaaacctcttcgccatgcaactagcaagttcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9474 - DNA, 312 bp, Artificial
  MsCOMT deletion introduced by TALEN pair MsCOMT_T01.1
tctcacaaaaacctcatcaatcacaacagcaaacctcttcgccatgcaactagcaagttcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9475 - DNA, 312 bp, Artificial
  MsCOMT deletion introduced by TALEN pair MsCOMT_T01.1
tctcacaaaaacctcatcaatcacaacagcaaacctcttcgccatgcaactagcaagttcttcagttcttcccatgattttaaaatcagctcttgaacttgatctcttagaattcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9476 - DNA, 312 bp, Artificial
  MsCOMT deletion introduced by TALEN pair MsCOMT_T01.1
tctcacaaaaacctcatcaatcacaacagcaaacctcttcgccatgcaactagcaagtgcttcagttcttcccatgattttgcaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9477 - DNA, 312 bp, Artificial
  MsCOMT deletion introduced by TALEN pair MsCOMT_T01.1
tctcacaaaaacctcatcaatcacaacagcaaacctcttcgccatgcaactagcaagtgcttcagttcttcccatgattttgaaatcagctcttgaacttgatctcttagaaatcattgctcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9478 - DNA, 312 bp, Artificial
  MsCOMT deletion introduced by TALEN pair MsCOMT_T01.1
tctcacaaaaacctcatcaatcacaacagcaaacctcttcgccatgcaactagcaagtgcttcagttcttcccatgattttgaaatcagctcttgaacttgatctcttagaaatcattgctaaagctggaccttgtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9479 - DNA, 312 bp, Artificial
  MsCOMT deletion introduced by TALEN pair MsCOMT_T01.1
tctcacaaaaacctcatcaatcacaacagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 9480 - DNA, 312 bp, Artificial
  MsCOMT deletion introduced by TALEN pair MsCOMT_T01.1
tctcacaaaaacctcatcaatcacaacagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 9481 - DNA, 312 bp, Artificial
  MsCOMT deletion introduced by TALEN pair MsCOMT_T01.1
tctcacaaaaacctcatcaatcacaacagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 9482 - DNA, 312 bp, Artificial
  MsCOMT deletion introduced by TALEN pair MsCOMT_T01.1
tctcacaaaaacctcatcaatcacaacagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9483 - DNA, 312 bp, Artificial
  MsCOMT deletion introduced by TALEN pair MsCOMT_T01.1
tctcacaaaaacctcatcaatcacaacagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagaccttatggtttggctactgttgctaa

SEQ ID NO: 9484 - DNA, 312 bp, Artificial
  MsCOMT deletion introduced by TALEN pair MsCOMT_T01.1
tctcacaaaaacctcatcaatcacaacagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9485 - DNA, 312 bp, Artificial
  MsCOMT deletion introduced by TALEN pair MsCOMT_T01.1
tctcacaaaaacctcatcaatcacaacagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9486 - DNA, 312 bp, Artificial
  MsCOMT deletion introduced by TALEN pair MsCOMT_T01.1
tctcacaaaaacctcatcaatcacaacagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9487 - DNA, 312 bp, Artificial
  MsCOMT deletion introduced by TALEN pair MsCOMT_T01.1
tctcacaaaaacctcatcaatcacaacagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9488 - DNA, 312 bp, Artificial
  MsCOMT deletion introduced by TALEN pair MsCOMT_T01.1
tctcacaaaaacctcatcaatcacaacagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9489 - DNA, 312 bp, Artificial
  MsCOMT deletion introduced by TALEN pair MsCOMT_T01.1
tctcacaaaaacctcatcaatcacaacagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactggtgctaa

SEQ ID NO: 9490 - DNA, 312 bp, Artificial
  MsCOMT deletion introduced by TALEN pair MsCOMT_T01.1
tctcacaaaaacctcatcaatcacaacagcaaacctcttcgccatgcaactagcaagtgcttcagttcttcccatgattttgaaatcagctcttgaacttgatctcttagaaatcattgctaaagctggacctggtgctcaaatttcacctattcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9491 - DNA, 312 bp, Artificial
  MsCOMT deletion introduced by TALEN pair MsCOMT_T01.1
tctcacaaaaacctcatcaatcacaacagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9492 - DNA, 312 bp, Artificial
  MsCOMT deletion introduced by TALEN pair MsCOMT_T01.1
tctcacaaaaacctcatcaatcacaacagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 9493 - DNA, 312 bp, Artificial
  MsCOMT deletion introduced by TALEN pair MsCOMT_T01.1
tctcacaaaaacctcatcaatcacaacagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9494 - DNA, 312 bp, Artificial
  MsCOMT deletion introduced by TALEN pair MsCOMT_T01.1
tctcacaaaaacctcatcaatcacaacagcaaacctcttcgccatgcaactagcaagtgcttcagttcttcccatgattttaaaatcagctcttgaacttgatctcttagaaatcattgctaaagctggacctggtgctcaaatttcacctattgaaattgtttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 9495 - DNA, 312 bp, Artificial
  MsCOMT deletion introduced by TALEN pair MsCOMT_T01.1
tctcacaaaaacctcatcaatcacaacagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9496 - DNA, 312 bp, Artificial
  MsCOMT deletion introduced by TALEN pair MsCOMT_T01.1
tctcacaaaaacctcatcaatcacaacagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9497 - DNA, 311 bp, Artificial
  MsCOMT deletion introduced by TALEN pair MsCOMT_T01.1
tctcacaaaaacctcatcaatcacaacagcaaacctcttcgccatgcaactaacaagtgcttcagttcttcccatgatttgaaatcagctcttgaacttgatctcttagaaatcattgctaaagctggacctggtactcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9498 - DNA, 333 bp, Artificial
  MsCOMT deletion introduced by TALEN pair MsCOMT_T01.1
tctcacaaaaacctcatcaatcacaacaatgggttcaacaggtgaagaagcaaccctcttcgccatgtaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9499 - DNA, 357 bp, Artificial
  MsCOMT deletion introduced by TALEN pair MsCOMT_T01.1
tctcacaaaaacctcatcaatcacaacaatgggttcaacaggtgaaactaaaatacacatatcagatgaagaagaaaacctcttcgccatgcaaatagcaagtgcttcagttcttcccatgattttgaaatcagctcttgaacttgatctcttagaaatcattgctaaagctggacctggtgctcaaatttcagctattgaaattgcttatcagctacctacaactaaccctgatgcaccagttatgttggaccgattgttgcgtctcttgtcttgttccaatatcctcactttttcagttcgtactcaacaagatggaaactttctcctactttatggtttggctactgttgctaa

SEQ ID NO: 9500 - DNA, 364 bp, Artificial
  MsCOMT deletion introduced by TALEN pair MsCOMT_T01.1
tctcacaaaaacctcatcaatcacaacaatgggttcaacaggtgaaactaaaataaacaaaacacataacagacgaagaagccaacctcttcgcaatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9501 - DNA, 351 bp, Artificial
  MsCOMT deletion introduced by TALEN pair MsCOMT_T01.1
tctcacaaaaacctcatcaatcacaaacatgggttcaacaggtgaaactcacatatcagatgaagaagcaaacctcttcgccatgcaactagcaagtgcttcagttcttcccaggattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggctttttacaatatcctcacttgttcagttcgtactcaacaagatggaaaggttccgagactttatggtttggctactgttgctaa

SEQ ID NO: 9502 - DNA, 362 bp, Artificial
  MsCOMT deletion introduced by TALEN pair MsCOMT_T01.1
tctcacaaaaacctcatcaatcacaaacatgggttcaacaggtgaaactcaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgaggcaccatttatgttggaccgaatgttgcgtctcttggcttgttacaatatcctcacttgttcagttcgtactcaacaagatggaaagattcagagcctttatggtttggctactgttgctaa

SEQ ID NO: 9503 - DNA, 356 bp, Artificial
  MsCOMT deletion introduced by TALEN pair MsCOMT_T01.1
tctcacaaaaacctcatcaatcacaaacatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9504 - DNA, 356 bp, Artificial
  MsCOMT deletion introduced by TALEN pair MsCOMT_T01.1
tctcacaaaaacctcatcaatcacaaacatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9505 - DNA, 359 bp, Artificial
  MsCOMT deletion introduced by TALEN pair MsCOMT_T01.1
tctcacaaaaacctcatcaatcacaaacatgggttcaacaggtgaaactcaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaattcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9506 - DNA, 360 bp, Artificial
  MsCOMT deletion introduced by TALEN pair MsCOMT_T01.1
tctcacaaaaacctcatcaatcacaaacatgggttcaacaggtgaaactcaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9507 - DNA, 354 bp, Artificial
  MsCOMT deletion introduced by TALEN pair MsCOMT_T01.1
tctcacaaaaacctcatcaatcacaaacatgggttcaacaggtgaaactcaacacatatcagatgaagaagcaaacctcttcgccatgccactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgatacaatatcctcacttgttcagttcgtactcaacaagatggaaaggttcagagactttatggtttggctactggtgctaa

SEQ ID NO: 9508 - DNA, 362 bp, Artificial
  MsCOMT deletion introduced by TALEN pair MsCOMT_T01.1
tctcacaaaaacctcatcaatcacaaacatgggttcaacaggtgaaactcaaatccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9509 - DNA, 361 bp, Artificial
  MsCOMT deletion introduced by TALEN pair MsCOMT_T01.1
tctcacaaaaacctcatcaatcacaaacatgggttcaacaggtgaaactcaaatcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9510 - DNA, 361 bp, Artificial
  MsCOMT deletion introduced by TALEN pair MsCOMT_T01.1
tctcacaaaaacctcatcaatcacaaacatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttagggtttggctactgttgctaa

SEQ ID NO: 9511 - DNA, 361 bp, Artificial
  MsCOMT deletion introduced by TALEN pair MsCOMT_T01.1
tctcacaaaaacctcatcaatcacaaacatgggttcaacaggtgaaactcaaatcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9512 - DNA, 359 bp, Artificial
  MsCOMT deletion introduced by TALEN pair MsCOMT_T01.1
tctcacaaaaacctcatcaatcacaaacatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9513 - DNA, 359 bp, Artificial
  MsCOMT deletion introduced by TALEN pair MsCOMT_T01.1
tctcacaaaaacctcatcaatcacaaacatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 9514 - DNA, 359 bp, Artificial
  MsCOMT deletion introduced by TALEN pair MsCOMT_T01.1
tctcacaaaaacctcatcaatcacaaacatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9515 - DNA, 359 bp, Artificial
  MsCOMT deletion introduced by TALEN pair MsCOMT_T01.1
tctcacaaaaacctcatcaatcacaaacatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 9516 - DNA, 359 bp, Artificial
  MsCOMT deletion introduced by TALEN pair MsCOMT_T01.1
tctcacaaaaacctcatcaatcacaaacatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggacctaatgttgcgtctcttggcttgttacaatatcctcacttgttcagttcatactcaacaagatggaaagattcagagactttatggtttggctactgttgctaa

SEQ ID NO: 9517 - DNA, 359 bp, Artificial
  MsCOMT deletion introduced by TALEN pair MsCOMT_T01.1
tctcacaaaaacctcatcaatcacaaacatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9518 - DNA, 358 bp, Artificial
  MsCOMT deletion introduced by TALEN pair MsCOMT_T01.1
tctcacaaaaacctcatcaatcacaaacatgggttcaacaggtgaaactcaaataccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactggtgctaa

SEQ ID NO: 9519 - DNA, 363 bp, Artificial
  MsCOMT deletion introduced by TALEN pair MsCOMT_T01.1
tctcacaaaaacctcatcaatcacaaacatgggttcaacaggtgaaactcaaataccaacccacatatcagatgaagaagcacacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 9520 - DNA, 362 bp, Artificial
  MsCOMT deletion introduced by TALEN pair MsCOMT_T01.1
tctcacaaaaacctcatcaatcacaaacatgggttcaacaggtgaaactcaaatacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9521 - DNA, 360 bp, Artificial
  MsCOMT deletion introduced by TALEN pair MsCOMT_T01.1
tctcacaaaaacctcatcaatcacaaacatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctacagttgctaa

SEQ ID NO: 9522 - DNA, 360 bp, Artificial
  MsCOMT deletion introduced by TALEN pair MsCOMT_T01.1
tctcacaaaaacctcatcaatcacaaacatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 9523 - DNA, 360 bp, Artificial
  MsCOMT deletion introduced by TALEN pair MsCOMT_T01.1
tctcacaaaaacctcatcaatcacaaacatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 9524 - DNA, 360 bp, Artificial
  MsCOMT deletion introduced by TALEN pair MsCOMT_T01.1
tctcacaaaaacctcatcaatcacaaacatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatctaaccctgatgcaccagttatgttggaccgaatgttgcgtctctttgctttttactatttcctcacttgttcagttcgtactcaacaagatgtaaatgttcagagactttatggtttggctactgttgctaa

SEQ ID NO: 9525 - DNA, 360 bp, Artificial
  MsCOMT deletion introduced by TALEN pair MsCOMT_T01.1
tctcacaaaaacctcatcaatcacaaacatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9526 - DNA, 360 bp, Artificial
  MsCOMT deletion introduced by TALEN pair MsCOMT_T01.1
tctcacaaaaacctcatcaatcacaaacatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9527 - DNA, 360 bp, Artificial
  MsCOMT deletion introduced by TALEN pair MsCOMT_T01.1
tctcacaaaaacctcatcaatcacaaacatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9528 - DNA, 360 bp, Artificial
  MsCOMT deletion introduced by TALEN pair MsCOMT_T01.1
tctcacaaaaacctcatcaatcacaaacatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9529 - DNA, 360 bp, Artificial
  MsCOMT deletion introduced by TALEN pair MsCOMT_T01.1
tctcacaaaaacctcatcaatcacaaacatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9530 - DNA, 360 bp, Artificial
  MsCOMT deletion introduced by TALEN pair MsCOMT_T01.1
tctcacaaaaacctcatcaatcacaaacatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctagtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9531 - DNA, 363 bp, Artificial
  MsCOMT deletion introduced by TALEN pair MsCOMT_T01.1
tctcacaaaaacctcatcaatcacaaacatgggttcaacaggtgaaactcaaataaccaacccacatatcagatgaagaagccaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttgctactgttgctaa

SEQ ID NO: 9532 - DNA, 364 bp, Artificial
  MsCOMT deletion introduced by TALEN pair MsCOMT_T01.1
tctcacaaaaacctcatcaatcacaaacatgggttcaacaggtgaaactcaaataaccaacccacatatcagatgaagaagcaaacctcttcgccattcaatgagcaagtgcttcagttcttcccatgattttaaaatcagctcttgaacttgatctcttagaaatcattgctaaagctggacctggtgctcaattttcacctattgaaattgcttctcagctcccaacaactaaccctgatgcacccgttatgttggaccgaatgttgcgtctcttggcttgttacaatatcctcacttgttcagttcttactcaacaagatggaaagattcagagactttatggtttggctactgttgctaa

SEQ ID NO: 9533 - DNA, 364 bp, Artificial
  MsCOMT deletion introduced by TALEN pair MsCOMT_T01.1
tctcacaaaaacctcatcaatcacaaacatgggttcaacaggtgaaactcaaataaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9534 - DNA, 364 bp, Artificial
  MsCOMT deletion introduced by TALEN pair MsCOMT_T01.1
tctcacaaaaacctcatcaatcacaaacatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9535 - DNA, 364 bp, Artificial
  MsCOMT deletion introduced by TALEN pair MsCOMT_T01.1
tctcacaaaaacctcatcaatcacaaacatgggttcaacaggtgaaactcaaataaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9536 - DNA, 364 bp, Artificial
  MsCOMT deletion introduced by TALEN pair MsCOMT_T01.1
tctcacaaaaacctcatcaatcacaaacatgggttcaacaggtgaaactcaaataaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9537 - DNA, 363 bp, Artificial
  MsCOMT deletion introduced by TALEN pair MsCOMT_T01.1
tctcacaaaaacctcatcaatcacaaacatgggttcaacaggtgaaactcaaataacaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9538 - DNA, 363 bp, Artificial
  MsCOMT deletion introduced by TALEN pair MsCOMT_T01.1
tctcacaaaaacctcatcaatcacaaacatgggttcaacaggtgaaactcaaataacaacccacatatcagatgaagaagcaaacatcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaacccttatgcaccagttatgttggaccgaatgttgcgtctcttggcttgtttcaatatcctcacttgttcagttcgtactcaacaagatggaaaggttcagagtctttatggtttggctactgttgctaa

SEQ ID NO: 9539 - DNA, 364 bp, Artificial
  MsCOMT deletion introduced by TALEN pair MsCOMT_T01.1
tctcacaaaaacctcatcaatcacaaacatgggttcaacaggtgaaactcaaataacaaacccacatatcagatgaagaagcaaacctcttcgccattcaactagcaagtgcttcagttcttcccatgattttgaaatcagctcttgaacttgatctcttagaaatcattgctaaagctggacctggtcctcaaatttcgcctattgaaattgcttctcagctaccaacaactaaccctgatgcaccagttatgttggaccgaatattgcgtctcttggcttgttacaatatcctcacttgttcagttcgtactcaacaatattgaaagattcagagtctttatggtttggctactgttgctaa

SEQ ID NO: 9540 - DNA, 361 bp, Artificial
  MsCOMT deletion introduced by TALEN pair MsCOMT_T01.1
tctcacaaaaacctcatcaatcacaaacatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9541 - DNA, 361 bp, Artificial
  MsCOMT deletion introduced by TALEN pair MsCOMT_T01.1
tctcacaaaaacctcatcaatcacaaacatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 9542 - DNA, 361 bp, Artificial
  MsCOMT deletion introduced by TALEN pair MsCOMT_T01.1
tctcacaaaaacctcatcaatcacaaacatgggttcaacaggtgaaactcaaataaacccacatatcagatgaagaagcaaacctcttcgccatgcaattagcaagtgcttcagttcttcccatgattttaaaatcaactcttgaacttgatctcttagaaatcattgctaaagctggaactggtgctcaaatttcacctattgaaattgcttctcagctcccaacaactaaccctgatgcaccagttatgttggaccgaatcttgcgtctctaggcttgttacaatatcctcacttgttcagtccgtacccaacaagatggaaaggttcagagactttatggtttggctactgttgctaa

SEQ ID NO: 9543 - DNA, 361 bp, Artificial
  MsCOMT deletion introduced by TALEN pair MsCOMT_T01.1
tctcacaaaaacctcatcaatcacaaacatgggttcaacaggtgaaactcaaataaacccacatatcagatgaagaagcaaacctcttcgccatgcaattagcaagtgcttcagttcttcccatgagtttaaaatcagctcttgaacttgatctcttagaaatcattgctaaagctggacctgttgctcaaatttcacctattgaaattgcttctcagctaccaacaactaaccctgatgcaccagttatgttggaccgaatgttgcgtctcttggcttgttacaatatcctcacttgttcagttcgtactcaacaagattgaaaggttcagagactttatggtttggctactgttgctaa

SEQ ID NO: 9544 - DNA, 361 bp, Artificial
  MsCOMT deletion introduced by TALEN pair MsCOMT_T01.1
tctcacaaaaacctcatcaatcacaaacatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaatttcttctcagctaccaacaactaaccctgatgcaccacttatgttggaccgaatgttgcgtctcttggcttgttacaatatcctcacttgttcagttcttactcaacaagattgaaaagttcagagactttatggtttggctactgttgctaa

SEQ ID NO: 9545 - DNA, 361 bp, Artificial
  MsCOMT deletion introduced by TALEN pair MsCOMT_T01.1
tctcacaaaaacctcatcaatcacaaacatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9546 - DNA, 361 bp, Artificial
  MsCOMT deletion introduced by TALEN pair MsCOMT_T01.1
tctcacaaaaacctcatcaatcacaaacatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9547 - DNA, 361 bp, Artificial
  MsCOMT deletion introduced by TALEN pair MsCOMT_T01.1
tctcacaaaaacctcatcaatcacaaacatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactggtgctaa

SEQ ID NO: 9548 - DNA, 362 bp, Artificial
  MsCOMT deletion introduced by TALEN pair MsCOMT_T01.1
tctcacaaaaacctcatcaatcacaaacatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9549 - DNA, 357 bp, Artificial
  MsCOMT deletion introduced by TALEN pair MsCOMT_T01.1
tctcacaaaaacctcatcaatcacaaacatgggttcaacaggtgaaactcaaacccacatatcatatgaagaagcaaacctcttagccctgcacttaacaaaagctgcagttcctcccatgattttaaaatcagcacttgaacttgatctcttagaaatcattgctaaaactggacctggtgctcaaatttcacctattgaaattgcttatcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9550 - DNA, 357 bp, Artificial
  MsCOMT deletion introduced by TALEN pair MsCOMT_T01.1
tctcacaaaaacctcatcaatcacaaacatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagaggctttatggtttggctactgttgctaa

SEQ ID NO: 9551 - DNA, 357 bp, Artificial
  MsCOMT deletion introduced by TALEN pair MsCOMT_T01.1
tctcacaaaaacctcatcaatcacaaacatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9552 - DNA, 357 bp, Artificial
  MsCOMT deletion introduced by TALEN pair MsCOMT_T01.1
tctcacaaaaacctcatcaatcacaaacatgggttcaacaggtgaaactcaaacccacatatcagatgaagaagcaaacctcttcgccatgcaactagcaagtgcttcagttcttcccatgattttgaaatcagctcttgaacttgatctcttagaaaacattgctaaagctggacctggtgctcaaatttcgcctattgaaattgcttctcagctaccaacaactaaccctgatgcaccagttatgttggaccgaatgttgcgtctcttggcttgttacaatatcctcacttgttcagttcgtactcaacaagatgtaaaggttcagatactttatgatttggctactgttgctaa

SEQ ID NO: 9553 - DNA, 357 bp, Artificial
  MsCOMT deletion introduced by TALEN pair MsCOMT_T01.1
tctcacaaaaacctcatcaatcacaaacatgggttcaacaggtgaaactcaaacccacatatcagatgaagaagcaaaactcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9554 - DNA, 357 bp, Artificial
  MsCOMT deletion introduced by TALEN pair MsCOMT_T01.1
tctcacaaaaacctcatcaatcacaaacatgggttcaacaggtgaaactcaaacccacatatcagatgaagaagaaaacctcttcgccatgcaattagcaagtgcttcagttcttaccatgattttaaaatcagctcttgaacttgatctcttagaaatcattgctaaagctggacctggtgctcaaatttcacctgttcaaattgcttctctgctcccaacaactaaccctgatgcaccagttatgttggaccgaatgttgcgtctcttggcttgttacaatatcctcactttttcagttcgtactcaacaagatggaaacattctgatactttatggtgtggctacttttgctaa

SEQ ID NO: 9555 - DNA, 355 bp, Artificial
  MsCOMT deletion introduced by TALEN pair MsCOMT_T01.1
tctcacaaaaacctcatcaatcacaaacatgggttcaacaggtgaaactcaaacacatatcagatgaagaagcaaacctcttcgccatgcaactagcaagtgcttcagttcttcccatgattttgaaatcatctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9556 - DNA, 360 bp, Artificial
  MsCOMT deletion introduced by TALEN pair MsCOMT_T01.1
tctcacaaaaacctcatcaatcacaaacatgggttcaacaggtgaaactcaaacaacccacatatcagattaagaagaaaacctcttcgccatgcaattaacaaatgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9557 - DNA, 360 bp, Artificial
  MsCOMT deletion introduced by TALEN pair MsCOMT_T01.1
tctcacaaaaacctcatcaatcacaaacatgggttcaacaggtgaaactcaaacaacccacatatcagatgaagaagcaaacctcttcgccatgcaattagcaagtgcttcagttcttcgcatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9558 - DNA, 358 bp, Artificial
  MsCOMT deletion introduced by TALEN pair MsCOMT_T01.1
tctcacaaaaacctcatcaatcacaaacatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9559 - DNA, 358 bp, Artificial
  MsCOMT deletion introduced by TALEN pair MsCOMT_T01.1
tctcacaaaaacctcatcaatcacaaacatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9560 - DNA, 358 bp, Artificial
  MsCOMT deletion introduced by TALEN pair MsCOMT_T01.1
tctcacaaaaacctcatcaatcacaaacatgggttcaacaggtgaaactcaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9561 - DNA, 359 bp, Artificial
  MsCOMT deletion introduced by TALEN pair MsCOMT_T01.1
tctcacaaaaacctcatcaatcacaaacatgggttcaacaggtgaaactcaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9562 - DNA, 351 bp, Artificial
  MsCOMT deletion introduced by TALEN pair MsCOMT_T01.1
tctcacaaaaacctcatcaatcacaaacatgggttcaacaggtgaaacccacatatcagatgaagaagcaaacctcttcgccatgcaattagcaagttcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgtttgaccgaatgttgcgtctcttggcttgttacaatatcctcacttgttcagttcgtactcaacaagatggaaaggttcagagactttatggtttggctactgttgctaa

SEQ ID NO: 9563 - DNA, 351 bp, Artificial
  MsCOMT deletion introduced by TALEN pair MsCOMT_T01.1
tctcacaaaaacctcatcaatcacaaacatgggttcaacaggtgaaacccacatatcagatgaagaagcaaacctcttcgccatgcaattagcaagttcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9564 - DNA, 351 bp, Artificial
  MsCOMT deletion introduced by TALEN pair MsCOMT_T01.1
tctcacaaaaacctcatcaatcacaaacatgggttcaacaggtgaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9565 - DNA, 354 bp, Artificial
  MsCOMT deletion introduced by TALEN pair MsCOMT_T01.1
tctcacaaaaacctcatcaatcacaaacatgggttcaacaggggaaataacccacatatcagatgaagaagcaaacatcttcgccatgccactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9566 - DNA, 357 bp, Artificial
  MsCOMT deletion introduced by TALEN pair MsCOMT_T01.1
tctcacaaaaacctcatcaatcacaaacatgggttcaacaggggaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9567 - DNA, 312 bp, Artificial
  MsCOMT deletion introduced by TALEN pair MsCOMT_T01.1
tctcacaaaaacctcatcaatcacaaaagcaaacctcttcgccatgcaactagcaagttcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9568 - DNA, 360 bp, Artificial
  MsCOMT deletion introduced by TALEN pair MsCOMT_T01.1
tctcacaaaaacctcatcaataacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9569 - DNA, 353 bp, Artificial
  MsCOMT deletion introduced by TALEN pair MsCOMT_T01.1
tctcacaaaaacctcatcaataacaaccatgggttcaacaggtgaaaaacccacatatcagatgaagaagcaaacctcttcgccacgcaattagcaagtgcttcagttcttccaatgattttaaaatcagctcttgaacttgatctcttagaaatcattgctaaagctgggcctggtactcaaattacacctattgaaattgcttctcagctaccaacatcgaacccttgtgcaccagttatgttggaccgaatgttgcgtctcttggcttgttacgatatccgcacttgttcagttcgtactcaacaagatggaaaggttcagagactttatggtttggatactgttgctaa

SEQ ID NO: 9570 - DNA, 363 bp, Artificial
  MsCOMT deletion introduced by TALEN pair MsCOMT_T01.1
tctcacaaaaacctcatcaaccacaaccatgggttcaacatgtgaaactcaaataaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggatcgaatgttgcgtctcttggcttgttacaatatcctcacttgttcagttcgtactcaacaagatggaaaagttcagagactttatggtttgctactgttgctaa

SEQ ID NO: 9571 - DNA, 359 bp, Artificial
  MsCOMT deletion introduced by TALEN pair MsCOMT_T01.1
tctcacaaaaacctcatcaaccacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 9572 - DNA, 359 bp, Artificial
  MsCOMT deletion introduced by TALEN pair MsCOMT_T01.1
tctcacaaaaacctcatcaaccacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 9573 - DNA, 361 bp, Artificial
  MsCOMT deletion introduced by TALEN pair MsCOMT_T01.1
tctcacaaaaacctcatcaaccacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9574 - DNA, 361 bp, Artificial
  MsCOMT deletion introduced by TALEN pair MsCOMT_T01.1
tctcacaaaaacctcatcaaatcacaaccatgggttcaacaggtgaaactcaactaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9575 - DNA, 361 bp, Artificial
  MsCOMT deletion introduced by TALEN pair MsCOMT_T01.1
tctcacaaaaacctcatcaaatcacaaccatgggttcaacaggtgaaactcaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9576 - DNA, 364 bp, Artificial
  MsCOMT deletion introduced by TALEN pair MsCOMT_T01.1
tctcacaaaaacctcatcaaatcacaaccatgggttcaacaggtgaaactcaaataccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9577 - DNA, 365 bp, Artificial
  MsCOMT deletion introduced by TALEN pair MsCOMT_T01.1
tctcacaaaaacctcatcaaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9578 - DNA, 362 bp, Artificial
  MsCOMT deletion introduced by TALEN pair MsCOMT_T01.1
tctcacaaaaacctcatcaaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9579 - DNA, 358 bp, Artificial
  MsCOMT deletion introduced by TALEN pair MsCOMT_T01.1
tctcacaaaaacctcatcaaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9580 - DNA, 354 bp, Artificial
  MsCOMT deletion introduced by TALEN pair MsCOMT_T01.1
tctcacaaaaacctcatcaaatcacaaccatgggttcaacaggtgaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9581 - DNA, 352 bp, Artificial
  MsCOMT deletion introduced by TALEN pair MsCOMT_T01.1
tctcacaaaaacctcataatcacaaccattggttcaacaggtgaaaaacccacatatcagatgaagaagcaaacctcttcgccatgcaactagcaagttcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9582 - DNA, 345 bp, Artificial
  MsCOMT deletion introduced by TALEN pair MsCOMT_T01.1
tctcacaaaaacctcataatcacaaccatgggttcaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9583 - DNA, 355 bp, Artificial
  MsCOMT deletion introduced by TALEN pair MsCOMT_T01.1
tctcacaaaaacctcataatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9584 - DNA, 356 bp, Artificial
  MsCOMT deletion introduced by TALEN pair MsCOMT_T01.1
tctcacaaaaacctcataatcacaaccatgggttcaacaggtgaaactcaaatccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9585 - DNA, 358 bp, Artificial
  MsCOMT deletion introduced by TALEN pair MsCOMT_T01.1
tctcacaaaaacctcataatcacaaccatgggttcaacaggtgaaactcaaatacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9586 - DNA, 357 bp, Artificial
  MsCOMT deletion introduced by TALEN pair MsCOMT_T01.1
tctcacaaaaacctcataatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctttgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9587 - DNA, 358 bp, Artificial
  MsCOMT deletion introduced by TALEN pair MsCOMT_T01.1
tctcacaaaaacctcataatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9588 - DNA, 362 bp, Artificial
  MsCOMT deletion introduced by TALEN pair MsCOMT_T01.1
tctcacaaaaacctcataatcacaaccatgggttcaacaggtgaaactcaaataccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9589 - DNA, 359 bp, Artificial
  MsCOMT deletion introduced by TALEN pair MsCOMT_T01.1
tctcacaaaaacctcataatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9590 - DNA, 359 bp, Artificial
  MsCOMT deletion introduced by TALEN pair MsCOMT_T01.1
tctcacaaaaacctcataatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9591 - DNA, 359 bp, Artificial
  MsCOMT deletion introduced by TALEN pair MsCOMT_T01.1
tctcacaaaaacctcataatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9592 - DNA, 359 bp, Artificial
  MsCOMT deletion introduced by TALEN pair MsCOMT_T01.1
tctcacaaaaacctcataatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9593 - DNA, 359 bp, Artificial
  MsCOMT deletion introduced by TALEN pair MsCOMT_T01.1
tctcacaaaaacctcataatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9594 - DNA, 359 bp, Artificial
  MsCOMT deletion introduced by TALEN pair MsCOMT_T01.1
tctcacaaaaacctcataatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9595 - DNA, 363 bp, Artificial
  MsCOMT deletion introduced by TALEN pair MsCOMT_T01.1
tctcacaaaaacctcataatcacaaccatgggttcaacaggtgaaactcaaataaccaacccacatatcagatgaagaagcacacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9596 - DNA, 363 bp, Artificial
  MsCOMT deletion introduced by TALEN pair MsCOMT_T01.1
tctcacaaaaacctcataatcacaaccatgggttcaacaggtgaaactcaaataaccaacccacatatcagatgaagaagcacacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9597 - DNA, 363 bp, Artificial
  MsCOMT deletion introduced by TALEN pair MsCOMT_T01.1
tctcacaaaaacctcataatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatattgcgtctcttggcttgttacaatatcctcacttgttcagttcgtactcaacaagatggaaaggttcagagactttatggtttggctactgtggcgaa

SEQ ID NO: 9598 - DNA, 363 bp, Artificial
  MsCOMT deletion introduced by TALEN pair MsCOMT_T01.1
tctcacaaaaacctcataatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 9599 - DNA, 362 bp, Artificial
  MsCOMT deletion introduced by TALEN pair MsCOMT_T01.1
tctcacaaaaacctcataatcacaaccatgggttcaacaggtgaaactcaaataacaacccacatatcagatgaagaagcaaccctcttcgccatgcaactagcaagtgcttcggttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9600 - DNA, 360 bp, Artificial
  MsCOMT deletion introduced by TALEN pair MsCOMT_T01.1
tctcacaaaaacctcataatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9601 - DNA, 360 bp, Artificial
  MsCOMT deletion introduced by TALEN pair MsCOMT_T01.1
tctcacaaaaacctcataatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9602 - DNA, 361 bp, Artificial
  MsCOMT deletion introduced by TALEN pair MsCOMT_T01.1
tctcacaaaaacctcataatcacaaccatgggttcaacaggtgaaactcaaataaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9603 - DNA, 356 bp, Artificial
  MsCOMT deletion introduced by TALEN pair MsCOMT_T01.1
tctcacaaaaacctcataatcacaaccatgggttcaacaggtgaaactcaaacccacatatcagatgaagaagcaaacctcttcgccatgcaattagcaagtgcttcagttcttcccatgattttgaaatcagctcttgaacttgatctcttagaaatcattgctaaagcgggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactgtatggtttggctactgttgctaa

SEQ ID NO: 9604 - DNA, 356 bp, Artificial
  MsCOMT deletion introduced by TALEN pair MsCOMT_T01.1
tctcacaaaaacctcataatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9605 - DNA, 350 bp, Artificial
  MsCOMT deletion introduced by TALEN pair MsCOMT_T01.1
tctcacaaaaacctcataatcacaaccatgggttcaacaggtgaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9606 - DNA, 351 bp, Artificial
  MsCOMT deletion introduced by TALEN pair MsCOMT_T01.1
tctcacaaaaacctcataatcacaaccatgggttcaacaggtgaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 9607 - DNA, 347 bp, Artificial
  MsCOMT deletion introduced by TALEN pair MsCOMT_T01.1
tctcacaaaaacctcataatcacaaccatgggttcaacaggtacccacatatcagatgaagaagcaaacctcttcgccatgccattagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 9608 - DNA, 343 bp, Artificial
  MsCOMT deletion introduced by TALEN pair MsCOMT_T01.1
tctcacaaaaacctcataatcacaaccatgggttcaacacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9609 - DNA, 356 bp, Artificial
  MsCOMT deletion introduced by TALEN pair MsCOMT_T01.1
tctcacaaaaacctcataatcacaaccatgggctcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagtttcagagactttatggtttggctactgttgctaa

SEQ ID NO: 9610 - DNA, 359 bp, Artificial
  MsCOMT deletion introduced by TALEN pair MsCOMT_T01.1
tctcacaaaaacctcataaatcacaaccatgggttcaacaggtgaaactcaccaacccacatatcagatgaagaagcaaacctcttcgccatgcaattagcaagtgcttcagttcttcccatgattttaaaatcagctcttgaacttgatctcttagaaatcattgctaaagctggacctggtgctcagatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9611 - DNA, 358 bp, Artificial
  MsCOMT deletion introduced by TALEN pair MsCOMT_T01.1
tctcacaaaaacctcataaatcacaaacatgggttcaacaggtgaaactcaaatcccacatatcagatgaagaagcaaacctattcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9612 - DNA, 364 bp, Artificial
  MsCOMT deletion introduced by TALEN pair MsCOMT_T01.1
tctcacaaaaacctcagcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9613 - DNA, 356 bp, Artificial
  MsCOMT deletion introduced by TALEN pair MsCOMT_T01.1
tctcacaaaaacctcaccaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9614 - DNA, 359 bp, Artificial
  MsCOMT deletion introduced by TALEN pair MsCOMT_T01.1
tctcacaaaaacctcaccaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9615 - DNA, 421 bp, Artificial
  MsCOMT deletion introduced by TALEN pair MsCOMT_T01.1
tctcacaaaaacctcaccaatcacaaccatgggttcaacaggtgaaactcaaataacctgggtcaagccgtgggcctggcaccgcaccggcaacagcctctggaccgtctccagcgcctgcttatcagatgaagaagcaaacctcttcgccatgcaattagcaagtgcttcagttcttcccatgattttaaaatcagctcttgaacttgatctcttagaaatcattgctaaagctggacctggtgctcaaatttcgcctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaac

SEQ ID NO: 9616 - DNA, 360 bp, Artificial
  MsCOMT deletion introduced by TALEN pair MsCOMT_T01.1
tctcacaaaaacctcaccaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgtcgcgtctcttggcttgttacaatatcctcacttgttcagttcgtactcaacaagatggaaaagttcagagactttatggtttggctactgttgctaa

SEQ ID NO: 9617 - DNA, 351 bp, Artificial
  MsCOMT deletion introduced by TALEN pair MsCOMT_T01.1
tctcacaaaaacctcaccaatcacaaccatgggttcaacaggtgaaacccacatatcagatgaagaagcaaacctcttcgccatgcaattagcaagtgcttcagttcttcccatgattttaaaattagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9618 - DNA, 361 bp, Artificial
  MsCOMT deletion introduced by TALEN pair MsCOMT_T01.1
tctcacaaaaacctcaccaatcacaaccatgggttcaacaggtaaaactcaaataaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9619 - DNA, 332 bp, Artificial
  MsCOMT deletion introduced by TALEN pair MsCOMT_T01.1
tctcacaaaaacctcacaatcacaaccatgggttcaacaggtgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9620 - DNA, 332 bp, Artificial
  MsCOMT deletion introduced by TALEN pair MsCOMT_T01.1
tctcacaaaaacctcacaatcacaaccatgggttcaacaggtgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9621 - DNA, 355 bp, Artificial
  MsCOMT deletion introduced by TALEN pair MsCOMT_T01.1
tctcacaaaaacctcacaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9622 - DNA, 358 bp, Artificial
  MsCOMT deletion introduced by TALEN pair MsCOMT_T01.1
tctcacaaaaacctcacaatcacaaccatgggttcaacaggtgaaactcaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggtactgttgctaa

SEQ ID NO: 9623 - DNA, 359 bp, Artificial
  MsCOMT deletion introduced by TALEN pair MsCOMT_T01.1
tctcacaaaaacctcacaatcacaaccatgggttcaacaggtgaaactcaaattacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9624 - DNA, 358 bp, Artificial
  MsCOMT deletion introduced by TALEN pair MsCOMT_T01.1
tctcacaaaaacctcacaatcacaaccatgggttcaacaggtgaaactcaaatccccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9625 - DNA, 358 bp, Artificial
  MsCOMT deletion introduced by TALEN pair MsCOMT_T01.1
tctcacaaaaacctcacaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9626 - DNA, 352 bp, Artificial
  MsCOMT deletion introduced by TALEN pair MsCOMT_T01.1
tctcacaaaaacctcacaatcacaaccatgggttcaacaggtgaaactcaaataactcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 9627 - DNA, 359 bp, Artificial
  MsCOMT deletion introduced by TALEN pair MsCOMT_T01.1
tctcacaaaaacctcacaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9628 - DNA, 359 bp, Artificial
  MsCOMT deletion introduced by TALEN pair MsCOMT_T01.1
tctcacaaaaacctcacaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgctggaccgaatgttgcgtctcttggcttgttacaatatcctcacttgttcagttcgtactcaacaagatggaaagattcagagactttatggtttggctactgttgctaa

SEQ ID NO: 9629 - DNA, 359 bp, Artificial
  MsCOMT deletion introduced by TALEN pair MsCOMT_T01.1
tctcacaaaaacctcacaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9630 - DNA, 363 bp, Artificial
  MsCOMT deletion introduced by TALEN pair MsCOMT_T01.1
tctcacaaaaacctcacaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9631 - DNA, 362 bp, Artificial
  MsCOMT deletion introduced by TALEN pair MsCOMT_T01.1
tctcacaaaaacctcacaatcacaaccatgggttcaacaggtgaaactcaaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9632 - DNA, 352 bp, Artificial
  MsCOMT deletion introduced by TALEN pair MsCOMT_T01.1
tctcacaaaaacctcacaatcacaaccatgggttcaacaggtgaaactcaaataaatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9633 - DNA, 360 bp, Artificial
  MsCOMT deletion introduced by TALEN pair MsCOMT_T01.1
tctcacaaaaacctcacaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9634 - DNA, 356 bp, Artificial
  MsCOMT deletion introduced by TALEN pair MsCOMT_T01.1
tctcacaaaaacctcacaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9635 - DNA, 359 bp, Artificial
  MsCOMT deletion introduced by TALEN pair MsCOMT_T01.1
tctcacaaaaacctcacaatcacaaccatgggttcaacaggtgaaactcaaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9636 - DNA, 357 bp, Artificial
  MsCOMT deletion introduced by TALEN pair MsCOMT_T01.1
tctcacaaaaacctcacaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9637 - DNA, 357 bp, Artificial
  MsCOMT deletion introduced by TALEN pair MsCOMT_T01.1
tctcacaaaaacctcacaatcacaaccatgggttcaacaggtgaaactcaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9638 - DNA, 357 bp, Artificial
  MsCOMT deletion introduced by TALEN pair MsCOMT_T01.1
tctcacaaaaacctcacaatcacaaccatgggttcaacaggtgaaactcaaaacccacagatcagatgaagaagcaaacctcttcgccatgcaactatcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9639 - DNA, 346 bp, Artificial
  MsCOMT deletion introduced by TALEN pair MsCOMT_T01.1
tctcacaaaaacctcacaatcacaaccatgggttcaacaggtccccacatatcagatgaagaatcaaacctcttcgccatgccattagcaagtgcttcagttcttcccatgattttaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9640 - DNA, 346 bp, Artificial
  MsCOMT deletion introduced by TALEN pair MsCOMT_T01.1
tctcacaaaaacctcacaatcacaaccatgggttcaacacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9641 - DNA, 361 bp, Artificial
  MsCOMT deletion introduced by TALEN pair MsCOMT_T01.1
tctcacaaaaacctcaatcacaaccatgggttcaacaggtgacactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9642 - DNA, 361 bp, Artificial
  MsCOMT deletion introduced by TALEN pair MsCOMT_T01.1
tctcacaaaaacctcaatcacaaccatgggttcaacaggtgaaactcaactaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9643 - DNA, 355 bp, Artificial
  MsCOMT deletion introduced by TALEN pair MsCOMT_T01.1
tctcacaaaaacctcaatcacaaccatgggttcaacaggtgaaactcaaataccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9644 - DNA, 360 bp, Artificial
  MsCOMT deletion introduced by TALEN pair MsCOMT_T01.1
tctcacaaaaacctcaatcaatcacaaccatgggttcaacaggtgaaactcaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 9645 - DNA, 357 bp, Artificial
  MsCOMT deletion introduced by TALEN pair MsCOMT_T01.1
tctcacaaaaacctcaatcaatcacaaccatgggttcaacaggtgaaactcaacccacatatcggatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9646 - DNA, 357 bp, Artificial
  MsCOMT deletion introduced by TALEN pair MsCOMT_T01.1
tctcacaaaaacctcaatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9647 - DNA, 345 bp, Artificial
  MsCOMT deletion introduced by TALEN pair MsCOMT_T01.1
tctcacaaaaacctcaatcaatcacaaccatgggttcaacacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9648 - DNA, 362 bp, Artificial
  MsCOMT deletion introduced by TALEN pair MsCOMT_T01.1
tctcacaaaaacctcaacaatcacaaccatgggttcaacaggtgaaactcaaatccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 9649 - DNA, 360 bp, Artificial
  MsCOMT deletion introduced by TALEN pair MsCOMT_T01.1
tctcacaaaaacctcaacaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgttctcaacaagatggaaaggttcagagactttatggtttggctactgttgctaa

SEQ ID NO: 9650 - DNA, 360 bp, Artificial
  MsCOMT deletion introduced by TALEN pair MsCOMT_T01.1
tctcacaaaaacctcaacaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9651 - DNA, 359 bp, Artificial
  MsCOMT deletion introduced by TALEN pair MsCOMT_T01.1
tctcacaaaaacctcaacaatcacaaccatgggttcaacaggtgaaactcaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9652 - DNA, 354 bp, Artificial
  MsCOMT deletion introduced by TALEN pair MsCOMT_T01.1
tctcacaaaaacctatcatcacaaccatgggttcaacaggtgaaactcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 9653 - DNA, 356 bp, Artificial
  MsCOMT deletion introduced by TALEN pair MsCOMT_T01.1
tctcacaaaaacctatcaatcacaaccatgggttcaacgggtgaaactcaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9654 - DNA, 337 bp, Artificial
  MsCOMT deletion introduced by TALEN pair MsCOMT_T01.1
tctcacaaaaacctatcaatcacaaccatgggttcaacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9655 - DNA, 337 bp, Artificial
  MsCOMT deletion introduced by TALEN pair MsCOMT_T01.1
tctcacaaaaacctatcaatcacaaccatgggttcaacatatcagatgaagaagcaaacctcttcgccatacaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9656 - DNA, 349 bp, Artificial
  MsCOMT deletion introduced by TALEN pair MsCOMT_T01.1
tctcacaaaaacctatcaatcacaaccatgggttcaacaggtgaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9657 - DNA, 355 bp, Artificial
  MsCOMT deletion introduced by TALEN pair MsCOMT_T01.1
tctcacaaaaacctatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9658 - DNA, 355 bp, Artificial
  MsCOMT deletion introduced by TALEN pair MsCOMT_T01.1
tctcacaaaaacctatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9659 - DNA, 355 bp, Artificial
  MsCOMT deletion introduced by TALEN pair MsCOMT_T01.1
tctcacaaaaacctatcaatcacaaccatgggttcaacaggtgaaactcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9660 - DNA, 354 bp, Artificial
  MsCOMT deletion introduced by TALEN pair MsCOMT_T01.1
tctcacaaaaacctatcaatcacaaccatgggttcaacaggtgaaactcaaccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9661 - DNA, 361 bp, Artificial
  MsCOMT deletion introduced by TALEN pair MsCOMT_T01.1
tctcacaaaaacctatcaatcacaaccatgggttcaacaggtgaaactcaaattcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttgtggtttggctactgttgctaa

SEQ ID NO: 9662 - DNA, 359 bp, Artificial
  MsCOMT deletion introduced by TALEN pair MsCOMT_T01.1
tctcacaaaaacctatcaatcacaaccatgggttcaacaggtgaaactcaaatcacccatatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9663 - DNA, 360 bp, Artificial
  MsCOMT deletion introduced by TALEN pair MsCOMT_T01.1
tctcacaaaaacctatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9664 - DNA, 358 bp, Artificial
  MsCOMT deletion introduced by TALEN pair MsCOMT_T01.1
tctcacaaaaacctatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9665 - DNA, 358 bp, Artificial
  MsCOMT deletion introduced by TALEN pair MsCOMT_T01.1
tctcacaaaaacctatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9666 - DNA, 354 bp, Artificial
  MsCOMT deletion introduced by TALEN pair MsCOMT_T01.1
tctcacaaaaacctatcaatcacaaccatgggttcaacaggtgaaactcaaatacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 9667 - DNA, 361 bp, Artificial
  MsCOMT deletion introduced by TALEN pair MsCOMT_T01.1
tctcacaaaaacctatcaatcacaaccatgggttcaacaggtgaaactcaaatacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9668 - DNA, 361 bp, Artificial
  MsCOMT deletion introduced by TALEN pair MsCOMT_T01.1
tctcacaaaaacctatcaatcacaaccatgggttcaacaggtgaaactcaaatacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9669 - DNA, 359 bp, Artificial
  MsCOMT deletion introduced by TALEN pair MsCOMT_T01.1
tctcacaaaaacctatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9670 - DNA, 359 bp, Artificial
  MsCOMT deletion introduced by TALEN pair MsCOMT_T01.1
tctcacaaaaacctatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaatttattctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 9671 - DNA, 359 bp, Artificial
  MsCOMT deletion introduced by TALEN pair MsCOMT_T01.1
tctcacaaaaacctatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9672 - DNA, 359 bp, Artificial
  MsCOMT deletion introduced by TALEN pair MsCOMT_T01.1
tctcacaaaaacctatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 9673 - DNA, 359 bp, Artificial
  MsCOMT deletion introduced by TALEN pair MsCOMT_T01.1
tctcacaaaaacctatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9674 - DNA, 359 bp, Artificial
  MsCOMT deletion introduced by TALEN pair MsCOMT_T01.1
tctcacaaaaacctatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9675 - DNA, 363 bp, Artificial
  MsCOMT deletion introduced by TALEN pair MsCOMT_T01.1
tctcacaaaaacctatcaatcacaaccatgggttcaacaggtgaaactcaaataaccaacccacatatcagatgaagaagcacacctcttcgccatgcaattaacaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9676 - DNA, 363 bp, Artificial
  MsCOMT deletion introduced by TALEN pair MsCOMT_T01.1
tctcacaaaaacctatcaatcacaaccatgggttcaacaggtgaaactcaaataaccaacccacatatcagatgaagaagcacacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9677 - DNA, 352 bp, Artificial
  MsCOMT deletion introduced by TALEN pair MsCOMT_T01.1
tctcacaaaaacctatcaatcacaaccatgggttcaacaggtgaaactcaaataaatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9678 - DNA, 360 bp, Artificial
  MsCOMT deletion introduced by TALEN pair MsCOMT_T01.1
tctcacaaaaacctatcaatcacaaccatgggttcaacaggtgaaactcaaataaacccacatatcggatgaagaagcaaacctcttcgccatgcaactagcaagtgcttcagttcttcccatgattttaaaatcagctcttgaacttgatctcttatcaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagtttcagagactttatggtttggctactgttgctaa

SEQ ID NO: 9679 - DNA, 360 bp, Artificial
  MsCOMT deletion introduced by TALEN pair MsCOMT_T01.1
tctcacaaaaacctatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9680 - DNA, 361 bp, Artificial
  MsCOMT deletion introduced by TALEN pair MsCOMT_T01.1
tctcacaaaaacctatcaatcacaaccatgggttcaacaggtgaaactcaaataaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9681 - DNA, 356 bp, Artificial
  MsCOMT deletion introduced by TALEN pair MsCOMT_T01.1
tctcacaaaaacctatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9682 - DNA, 356 bp, Artificial
  MsCOMT deletion introduced by TALEN pair MsCOMT_T01.1
tctcacaaaaacctatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9683 - DNA, 356 bp, Artificial
  MsCOMT deletion introduced by TALEN pair MsCOMT_T01.1
tctcacaaaaacctatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9684 - DNA, 358 bp, Artificial
  MsCOMT deletion introduced by TALEN pair MsCOMT_T01.1
tctcacaaaaacctatcaatcacaaccatgggttcaacaggtgaaactcaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttgcaatatcctcacttgttcagttcgtactcaacaagatggaaaggttcagagactttatggtttggctactgttgctaa

SEQ ID NO: 9685 - DNA, 331 bp, Artificial
  MsCOMT deletion introduced by TALEN pair MsCOMT_T01.1
tctcacaaaaacctatcaatcacaaccatgggttcaacaggtgaaaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9686 - DNA, 351 bp, Artificial
  MsCOMT deletion introduced by TALEN pair MsCOMT_T01.1
tctcacaaaaacctatcaatcacaaccatgggttcaacaggtgaaaacccacatatcatatgaagaagcaaacctcttcgccctgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9687 - DNA, 351 bp, Artificial
  MsCOMT deletion introduced by TALEN pair MsCOMT_T01.1
tctcacaaaaacctatcaatcacaaccatgggttcaacaggtgaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9688 - DNA, 359 bp, Artificial
  MsCOMT deletion introduced by TALEN pair MsCOMT_T01.1
tctcacaaaaacctaatcaatcacaaccatgggttcaacaggtgaaactcaaataaccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9689 - DNA, 364 bp, Artificial
  MsCOMT deletion introduced by TALEN pair MsCOMT_T01.1
tctcacaaaaaccgcatcaatcacaaccatgggttcaacaggtgaaactcaaataaccaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9690 - DNA, 356 bp, Artificial
  MsCOMT deletion introduced by TALEN pair MsCOMT_T01.1
tctcacaaaaaccgcatcaatcacaaccatgggttcaacaggtgaaactcaaataacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9691 - DNA, 360 bp, Artificial
  MsCOMT deletion introduced by TALEN pair MsCOMT_T01.1
tctcacaaaaaccctcatcaatcacaaccatgggttcaacaggtgaaactcaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9692 - DNA, 344 bp, Artificial
  MsCOMT deletion introduced by TALEN pair MsCOMT_T01.1
tctcacaaaaaccctcatcaatcacaaccatgggttcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9693 - DNA, 359 bp, Artificial
  MsCOMT deletion introduced by TALEN pair MsCOMT_T01.1
tctcacaaaaaccccatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9694 - DNA, 364 bp, Artificial
  MsCOMT deletion introduced by TALEN pair MsCOMT_T01.1
tctcacaaaaaccccatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9695 - DNA, 363 bp, Artificial
  MsCOMT deletion introduced by TALEN pair MsCOMT_T01.1
tctcacaaaaaccccatcaatcacaaccatgggttcaacaggtgaaactcaaataacaacccacatatcagatgaagaagcacacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9696 - DNA, 358 bp, Artificial
  MsCOMT deletion introduced by TALEN pair MsCOMT_T01.1
tctcacaaaaacccatcatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggcgactgttgctaa

SEQ ID NO: 9697 - DNA, 358 bp, Artificial
  MsCOMT deletion introduced by TALEN pair MsCOMT_T01.1
tctcacaaaaacccatcaatcacaaccatgggttcaacaggtgaaactccacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 9698 - DNA, 349 bp, Artificial
  MsCOMT deletion introduced by TALEN pair MsCOMT_T01.1
tctcacaaaaacccatcaatcacaaccatgggttcaacaggtgaaactcaatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9699 - DNA, 355 bp, Artificial
  MsCOMT deletion introduced by TALEN pair MsCOMT_T01.1
tctcacaaaaacccatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9700 - DNA, 355 bp, Artificial
  MsCOMT deletion introduced by TALEN pair MsCOMT_T01.1
tctcacaaaaacccatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9701 - DNA, 360 bp, Artificial
  MsCOMT deletion introduced by TALEN pair MsCOMT_T01.1
tctcacaaaaacccatcaatcacaaccatgggttcaacaggtgaaactcaaatcaacccacatatcagatgaagaagcaaacctcttcgctatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9702 - DNA, 358 bp, Artificial
  MsCOMT deletion introduced by TALEN pair MsCOMT_T01.1
tctcacaaaaacccatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9703 - DNA, 358 bp, Artificial
  MsCOMT deletion introduced by TALEN pair MsCOMT_T01.1
tctcacaaaaacccatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9704 - DNA, 358 bp, Artificial
  MsCOMT deletion introduced by TALEN pair MsCOMT_T01.1
tctcacaaaaacccatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9705 - DNA, 361 bp, Artificial
  MsCOMT deletion introduced by TALEN pair MsCOMT_T01.1
tctcacaaaaacccatcaatcacaaccatgggttcaacaggtgaaactcaaataccaacccacatatcagatgaagaagcaaacctcttcgccatgcaattagcaagtgcttcagttcttcccatgattttgaaatcagctcttgaacttgatctcttagaaatcattctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9706 - DNA, 359 bp, Artificial
  MsCOMT deletion introduced by TALEN pair MsCOMT_T01.1
tctcacaaaaacccatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9707 - DNA, 359 bp, Artificial
  MsCOMT deletion introduced by TALEN pair MsCOMT_T01.1
tctcacaaaaacccatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9708 - DNA, 359 bp, Artificial
  MsCOMT deletion introduced by TALEN pair MsCOMT_T01.1
tctcacaaaaacccatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9709 - DNA, 359 bp, Artificial
  MsCOMT deletion introduced by TALEN pair MsCOMT_T01.1
tctcacaaaaacccatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9710 - DNA, 363 bp, Artificial
  MsCOMT deletion introduced by TALEN pair MsCOMT_T01.1
tctcacaaaaacccatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9711 - DNA, 362 bp, Artificial
  MsCOMT deletion introduced by TALEN pair MsCOMT_T01.1
tctcacaaaaacccatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9712 - DNA, 360 bp, Artificial
  MsCOMT deletion introduced by TALEN pair MsCOMT_T01.1
tctcacaaaaacccatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9713 - DNA, 360 bp, Artificial
  MsCOMT deletion introduced by TALEN pair MsCOMT_T01.1
tctcacaaaaacccatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9714 - DNA, 356 bp, Artificial
  MsCOMT deletion introduced by TALEN pair MsCOMT_T01.1
tctcacaaaaacccatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9715 - DNA, 357 bp, Artificial
  MsCOMT deletion introduced by TALEN pair MsCOMT_T01.1
tctcacaaaaacccatcaatcacaaccatgggttcaacaggtgaaactcaaaacccacatatcagatgaagaagcaaacctcttcgccctgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9716 - DNA, 357 bp, Artificial
  MsCOMT deletion introduced by TALEN pair MsCOMT_T01.1
tctcacaaaaacccatcaatcacaaccatgggttcaacaggtgaaactcaaaacccacatatcagatgaagaagcaaacctcttcgccatgcaattatcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9717 - DNA, 357 bp, Artificial
  MsCOMT deletion introduced by TALEN pair MsCOMT_T01.1
tctcacaaaaacccatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatgggttggctactgttgcaaa

SEQ ID NO: 9718 - DNA, 357 bp, Artificial
  MsCOMT deletion introduced by TALEN pair MsCOMT_T01.1
tctcacaaaaacccatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatgggttggctactgttgctaa

SEQ ID NO: 9719 - DNA, 357 bp, Artificial
  MsCOMT deletion introduced by TALEN pair MsCOMT_T01.1
tctcacaaaaacccatcaatcacaaccatgggttcaacaggtgaaactcaaaacccacagatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggagaggttcagagactttatggtttggctactgttgctaa

SEQ ID NO: 9720 - DNA, 343 bp, Artificial
  MsCOMT deletion introduced by TALEN pair MsCOMT_T01.1
tctcacaaaaacccatcaatcacaaccatgggttcaacacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9721 - DNA, 353 bp, Artificial
  MsCOMT deletion introduced by TALEN pair MsCOMT_T01.1
tctcacaaaaacccaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9722 - DNA, 354 bp, Artificial
  MsCOMT deletion introduced by TALEN pair MsCOMT_T01.1
tctcacaaaaaccatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9723 - DNA, 358 bp, Artificial
  MsCOMT deletion introduced by TALEN pair MsCOMT_T01.1
tctcacaaaaaccatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9724 - DNA, 358 bp, Artificial
  MsCOMT deletion introduced by TALEN pair MsCOMT_T01.1
tctcacaaaaaccatcaatcacaaccatgggttcaacaggtgaaactcaaataacccacatatcagatgaagaagcaaacctcttcgccatgcaactatcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9725 - DNA, 355 bp, Artificial
  MsCOMT deletion introduced by TALEN pair MsCOMT_T01.1
tctcacaaaaaccatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 9726 - DNA, 357 bp, Artificial
  MsCOMT deletion introduced by TALEN pair MsCOMT_T01.1
tctcacaaaaaccacatcaatcacaaccatgggttcaacaggtgaaactcaaacccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaggatggaaaggttcagagactttatggtttggctactgttgctaa

SEQ ID NO: 9727 - DNA, 357 bp, Artificial
  MsCOMT deletion introduced by TALEN pair MsCOMT_T01.1
tctcacaaaaacatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9728 - DNA, 337 bp, Artificial
  MsCOMT deletion introduced by TALEN pair MsCOMT_T01.1
tctcacaaaaaactcatcaatcacaaccatgggttcacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtaaccaacaagatggaaagattcagagactttatggtttggctactgttgctaa

SEQ ID NO: 9729 - DNA, 342 bp, Artificial
  MsCOMT deletion introduced by TALEN pair MsCOMT_T01.1
tctcacaaaaaactcatcaatcacaaccatgggttcaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9730 - DNA, 342 bp, Artificial
  MsCOMT deletion introduced by TALEN pair MsCOMT_T01.1
tctcacaaaaaactcatcaatcacaaccatgggttcaacccacatatcagatgaagaagcaaacctcttcgccatgcaattagcaagtgcttcagttcttcccatgattttaaaatcagctcttgaacttgatctcttagaaatcattgctaaagctggacctggtgctcaaattttacctattgaaattgattctcagctcccaacaactaaccctgatgcaccagttatgttggaccgaatgttgcgtctcttggcttgttacaatatcctcactttttcatttcgtactcaacaagatggaaaggttcagagactttatggttttgctactgttgctaa

SEQ ID NO: 9731 - DNA, 333 bp, Artificial
  MsCOMT deletion introduced by TALEN pair MsCOMT_T01.1
tctcacaaaaaactcatcaatcacaaccatgggttcaacaggtgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9732 - DNA, 352 bp, Artificial
  MsCOMT deletion introduced by TALEN pair MsCOMT_T01.1
tctcacaaaaaactcatcaatcacaaccatgggttcaacaggtgaaactccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9733 - DNA, 350 bp, Artificial
  MsCOMT deletion introduced by TALEN pair MsCOMT_T01.1
tctcacaaaaaactcatcaatcacaaccatgggttcaacaggtgaaactcaatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9734 - DNA, 356 bp, Artificial
  MsCOMT deletion introduced by TALEN pair MsCOMT_T01.1
tctcacaaaaaactcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9735 - DNA, 356 bp, Artificial
  MsCOMT deletion introduced by TALEN pair MsCOMT_T01.1
tctcacaaaaaactcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9736 - DNA, 360 bp, Artificial
  MsCOMT deletion introduced by TALEN pair MsCOMT_T01.1
tctcacaaaaaactcatcaatcacaaccatgggttcaacaggtgaaactcaaccaacccacatatcagatgaagaagcaaacctcttcgccatgcaattagcaattgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9737 - DNA, 360 bp, Artificial
  MsCOMT deletion introduced by TALEN pair MsCOMT_T01.1
tctcacaaaaaactcatcaatcacaaccatgggttcaacaggtgaaactcaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9738 - DNA, 358 bp, Artificial
  MsCOMT deletion introduced by TALEN pair MsCOMT_T01.1
tctcacaaaaaactcatcaatcacaaccatgggttcaacaggtgaaactcaaatcccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9739 - DNA, 359 bp, Artificial
  MsCOMT deletion introduced by TALEN pair MsCOMT_T01.1
tctcacaaaaaactcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9740 - DNA, 359 bp, Artificial
  MsCOMT deletion introduced by TALEN pair MsCOMT_T01.1
tctcacaaaaaactcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttcgctactgttgctaa

SEQ ID NO: 9741 - DNA, 359 bp, Artificial
  MsCOMT deletion introduced by TALEN pair MsCOMT_T01.1
tctcacaaaaaactcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9742 - DNA, 358 bp, Artificial
  MsCOMT deletion introduced by TALEN pair MsCOMT_T01.1
tctcacaaaaaactcatcaatcacaaccatgggttcaacaggtgaaactcaaataccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttgggccgaatgttgcgtctcttggcttgttacaatatcctcacttgttcagttcgtactcaacaagatggaaagattcagagactttatggtttggctactgttgctaa

SEQ ID NO: 9743 - DNA, 360 bp, Artificial
  MsCOMT deletion introduced by TALEN pair MsCOMT_T01.1
tctcacaaaaaactcatcaatcacaaccatgggttcaacaggtgaaactcaaataacccacatatcagattaagaagcaaacctcttcgccatgcaattagcaagtgcttcagttcttcccatgattttaaaatcagctcttgaacttgatctcttagaaatcattgctaaggctggacctggtgctcaaatttcacctattgaaattgcttctcagctaccaacaactaaccctgatgcaccagttatgttggaccgaatgttgcgtctcttggcttgttacaatatcctcactttttcatttcgtactcaacaagatggaaaagttcagagcctttatggtttggctactgttgctaa

SEQ ID NO: 9744 - DNA, 360 bp, Artificial
  MsCOMT deletion introduced by TALEN pair MsCOMT_T01.1
tctcacaaaaaactcatcaatcacaaccatgggttcaacaggtgaaactcaaataacccacatatcagattaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9745 - DNA, 360 bp, Artificial
  MsCOMT deletion introduced by TALEN pair MsCOMT_T01.1
tctcacaaaaaactcatcaatcacaaccatgggttcaacaggtgaaactcaaataacccacatatcagatgaagaagcaaacctcttcgccatgcaattagcaattgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9746 - DNA, 360 bp, Artificial
  MsCOMT deletion introduced by TALEN pair MsCOMT_T01.1
tctcacaaaaaactcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9747 - DNA, 359 bp, Artificial
  MsCOMT deletion introduced by TALEN pair MsCOMT_T01.1
tctcacaaaaaactcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttgctactgttgctaa

SEQ ID NO: 9748 - DNA, 360 bp, Artificial
  MsCOMT deletion introduced by TALEN pair MsCOMT_T01.1
tctcacaaaaaactcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9749 - DNA, 360 bp, Artificial
  MsCOMT deletion introduced by TALEN pair MsCOMT_T01.1
tctcacaaaaaactcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9750 - DNA, 360 bp, Artificial
  MsCOMT deletion introduced by TALEN pair MsCOMT_T01.1
tctcacaaaaaactcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaacgagtgttgcgtctcttggcttgttccaatatcctcccttgttaagttcgtactcaacacgatggacaggttcagagactttatagtttggctactgttgctaa

SEQ ID NO: 9751 - DNA, 360 bp, Artificial
  MsCOMT deletion introduced by TALEN pair MsCOMT_T01.1
tctcacaaaaaactcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9752 - DNA, 360 bp, Artificial
  MsCOMT deletion introduced by TALEN pair MsCOMT_T01.1
tctcacaaaaaactcatcaatcacaaccatgggttcaacaggtgaaactcaaataacccacatatcagatgaagaagcaaacctcttcgccatgcaactagcaagtgcttcagttcttcccatgattttgaaatcagctcttgaacttggtctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9753 - DNA, 360 bp, Artificial
  MsCOMT deletion introduced by TALEN pair MsCOMT_T01.1
tctcacaaaaaactcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9754 - DNA, 360 bp, Artificial
  MsCOMT deletion introduced by TALEN pair MsCOMT_T01.1
tctcacaaaaaactcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 9755 - DNA, 360 bp, Artificial
  MsCOMT deletion introduced by TALEN pair MsCOMT_T01.1
tctcacaaaaaactcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9756 - DNA, 360 bp, Artificial
  MsCOMT deletion introduced by TALEN pair MsCOMT_T01.1
tctcacaaaaaactcatcaatcacaaccatgggttcaacaggtgaaactcaaataacccacatatcagatgaagaagcaaacctcttcgccatgcaactagcaagtgcttcagttcttcccatgattttaagatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 9757 - DNA, 360 bp, Artificial
  MsCOMT deletion introduced by TALEN pair MsCOMT_T01.1
tctcacaaaaaactcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggttctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9758 - DNA, 360 bp, Artificial
  MsCOMT deletion introduced by TALEN pair MsCOMT_T01.1
tctcacaaaaaactcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9759 - DNA, 364 bp, Artificial
  MsCOMT deletion introduced by TALEN pair MsCOMT_T01.1
tctcacaaaaaactcatcaatcacaaccatgggttcaacaggtgaaactcaaataaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9760 - DNA, 364 bp, Artificial
  MsCOMT deletion introduced by TALEN pair MsCOMT_T01.1
tctcacaaaaaactcatcaatcacaaccatgggttcaacaggtgaaactcaaataaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9761 - DNA, 364 bp, Artificial
  MsCOMT deletion introduced by TALEN pair MsCOMT_T01.1
tctcacaaaaaactcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggcgactgttgctaa

SEQ ID NO: 9762 - DNA, 364 bp, Artificial
  MsCOMT deletion introduced by TALEN pair MsCOMT_T01.1
tctcacaaaaaactcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9763 - DNA, 364 bp, Artificial
  MsCOMT deletion introduced by TALEN pair MsCOMT_T01.1
tctcacaaaaaactcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9764 - DNA, 364 bp, Artificial
  MsCOMT deletion introduced by TALEN pair MsCOMT_T01.1
tctcacaaaaaactcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9765 - DNA, 364 bp, Artificial
  MsCOMT deletion introduced by TALEN pair MsCOMT_T01.1
tctcacaaaaaactcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9766 - DNA, 364 bp, Artificial
  MsCOMT deletion introduced by TALEN pair MsCOMT_T01.1
tctcacaaaaaactcatcaatcacaaccatgggttcaacaggtgaaactcaaataaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9767 - DNA, 363 bp, Artificial
  MsCOMT deletion introduced by TALEN pair MsCOMT_T01.1
tctcacaaaaaactcatcaatcacaaccatgggttcaacaggtgaaactcaaataacaacccacatatcagatgaagaagcacacctcttcgccatgcaactagcaagtgcttcagatcttcccatgattttgaaatcagctcttgaacttgatctcttagaaatcattgctaaagctggacctgtcgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9768 - DNA, 363 bp, Artificial
  MsCOMT deletion introduced by TALEN pair MsCOMT_T01.1
tctcacaaaaaactcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttgtggtttggctactgttgctaa

SEQ ID NO: 9769 - DNA, 363 bp, Artificial
  MsCOMT deletion introduced by TALEN pair MsCOMT_T01.1
tctcacaaaaaactcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9770 - DNA, 361 bp, Artificial
  MsCOMT deletion introduced by TALEN pair MsCOMT_T01.1
tctcacaaaaaactcatcaatcacaaccatgggttcaacaggtgaaactcaaataaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcatctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9771 - DNA, 361 bp, Artificial
  MsCOMT deletion introduced by TALEN pair MsCOMT_T01.1
tctcacaaaaaactcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9772 - DNA, 361 bp, Artificial
  MsCOMT deletion introduced by TALEN pair MsCOMT_T01.1
tctcacaaaaaactcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9773 - DNA, 364 bp, Artificial
  MsCOMT deletion introduced by TALEN pair MsCOMT_T01.1
tctcacaaaaaactcatcaatcacaaccatgggttcaacaggtgaaactcaaataaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9774 - DNA, 362 bp, Artificial
  MsCOMT deletion introduced by TALEN pair MsCOMT_T01.1
tctcacaaaaaactcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9775 - DNA, 362 bp, Artificial
  MsCOMT deletion introduced by TALEN pair MsCOMT_T01.1
tctcacaaaaaactcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9776 - DNA, 362 bp, Artificial
  MsCOMT deletion introduced by TALEN pair MsCOMT_T01.1
tctcacaaaaaactcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9777 - DNA, 357 bp, Artificial
  MsCOMT deletion introduced by TALEN pair MsCOMT_T01.1
tctcacaaaaaactcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9778 - DNA, 357 bp, Artificial
  MsCOMT deletion introduced by TALEN pair MsCOMT_T01.1
tctcacaaaaaactcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9779 - DNA, 357 bp, Artificial
  MsCOMT deletion introduced by TALEN pair MsCOMT_T01.1
tctcacaaaaaactcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9780 - DNA, 357 bp, Artificial
  MsCOMT deletion introduced by TALEN pair MsCOMT_T01.1
tctcacaaaaaactcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9781 - DNA, 356 bp, Artificial
  MsCOMT deletion introduced by TALEN pair MsCOMT_T01.1
tctcacaaaaaactcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctgacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9782 - DNA, 357 bp, Artificial
  MsCOMT deletion introduced by TALEN pair MsCOMT_T01.1
tctcacaaaaaactcatcaatcacaaccatgggttcaacaggtgaaactcaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgagtgttgcgtctcttggcttgttacaatatcctcacttgttcagttcgtactcaacaagatggaaaggttcagagactttatggtttggctactgttgctaa

SEQ ID NO: 9783 - DNA, 361 bp, Artificial
  MsCOMT deletion introduced by TALEN pair MsCOMT_T01.1
tctcacaaaaaactcatcaatcacaaccatgggttcaacaggtgaaactcaaacaaacccacatatcagatgaagaagcaaacctcttcgccatgcaactagcaaatgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatgtaaaggttcagagactttatggtttggctactgttgctaa

SEQ ID NO: 9784 - DNA, 359 bp, Artificial
  MsCOMT deletion introduced by TALEN pair MsCOMT_T01.1
tctcacaaaaaactcatcaatcacaaccatgggttcaacaggtgaaactcaaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9785 - DNA, 351 bp, Artificial
  MsCOMT deletion introduced by TALEN pair MsCOMT_T01.1
tctcacaaaaaactcatcaatcacaaccatgggttcaacaggtgaaacccacatatcagatgaagaagcaaacctcttcgccctgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9786 - DNA, 357 bp, Artificial
  MsCOMT deletion introduced by TALEN pair MsCOMT_T01.1
tctcacaaaaaactcatcaatcacaaccatgggttcaacaggtgaaaatcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9787 - DNA, 353 bp, Artificial
  MsCOMT deletion introduced by TALEN pair MsCOMT_T01.1
tctcacaaaaaactcatcaatcacaaccatgggttcaacaggtgaaaaacccacatatcagattaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9788 - DNA, 348 bp, Artificial
  MsCOMT deletion introduced by TALEN pair MsCOMT_T01.1
tctcacaaaaaactcatcaatcacaaccatgggttcaacaggtacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9789 - DNA, 348 bp, Artificial
  MsCOMT deletion introduced by TALEN pair MsCOMT_T01.1
tctcacaaaaaactcatcaatcacaaccatgggttcaacaggtacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcgtggcttgttacaatatcctcacttgttcagttcgtactcaacaagatggaaagattcagagactttatggtttggctactgttgctaa

SEQ ID NO: 9790 - DNA, 358 bp, Artificial
  MsCOMT deletion introduced by TALEN pair MsCOMT_T01.1
tctcacaaaaaactcatcaatcacaaccatgggttcaacaggcgaaactcaaataccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9791 - DNA, 360 bp, Artificial
  MsCOMT deletion introduced by TALEN pair MsCOMT_T01.1
tctcacaaaaaactcatcaatcacaaacatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9792 - DNA, 359 bp, Artificial
  MsCOMT deletion introduced by TALEN pair MsCOMT_T01.1
tctcacaaaaaactcataatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9793 - DNA, 351 bp, Artificial
  MsCOMT deletion introduced by TALEN pair MsCOMT_T01.1
tctcacaaaaaacctcatcaatcacaaccatgggttcaacaggtgaaactcaatatcagatgaagaagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9794 - DNA, 366 bp, Artificial
  MsCOMT deletion introduced by TALEN pair MsCOMT_T01.1
tctcacaaaaaacctcatcaatcacaaccatgggttcaacaggtgaaactcaaatacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9795 - DNA, 361 bp, Artificial
  MsCOMT deletion introduced by TALEN pair MsCOMT_T01.1
tctcacaaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9796 - DNA, 358 bp, Artificial
  MsCOMT deletion introduced by TALEN pair MsCOMT_T01.1
tctcacaaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9797 - DNA, 359 bp, Artificial
  MsCOMT deletion introduced by TALEN pair MsCOMT_T01.1
tctcacaaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9798 - DNA, 358 bp, Artificial
  MsCOMT deletion introduced by TALEN pair MsCOMT_T01.1
tctcaacctcatcaatcacaaccatgggttcaacaggtgaaactcaaataccaacccacatatcagatgaagaagcaaacctcttcgccatgcaactatcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9799 - DNA, 360 bp, Artificial
  MsCOMT deletion introduced by TALEN pair MsCOMT_T01.1
tctcaacaaaaacctcatcaatcacaaccatgggttcaacaggtgaaactcaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtcccttggcttgttacaatatcctcacttgttcagttcgtactcaacaagatggaaagattcagagactttatggtttggctactgttgctaa

SEQ ID NO: 9800 - DNA, 359 bp, Artificial
  MsCOMT deletion introduced by TALEN pair MsCOMT_T01.1
tctcaacaaaaacctcatcaatcacaaccatgggttcaacaggtgaaactcaaatacccacatatcagattaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttgctactgttgctaa

SEQ ID NO: 9801 - DNA, 363 bp, Artificial
  MsCOMT deletion introduced by TALEN pair MsCOMT_T01.1
tctcaaagaaacctcatcaatcacaaccatgggttcaacaggtgaaactcaaatacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaaa

SEQ ID NO: 9802 - DNA, 354 bp, Artificial
  MsCOMT deletion introduced by TALEN pair MsCOMT_T01.1
tctcaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9803 - DNA, 354 bp, Artificial
  MsCOMT deletion introduced by TALEN pair MsCOMT_T01.1
tctcaaacctcatcaatcacaaccatgggttcaacaggtgaaactcaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9804 - DNA, 355 bp, Artificial
  MsCOMT deletion introduced by TALEN pair MsCOMT_T01.1
tctcaaaatacctcatcaatcacaaccatgggttcaacaggtgaaactcaaataacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9805 - DNA, 355 bp, Artificial
  MsCOMT deletion introduced by TALEN pair MsCOMT_T01.1
tctcaaaactcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9806 - DNA, 358 bp, Artificial
  MsCOMT deletion introduced by TALEN pair MsCOMT_T01.1
tctcaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 9807 - DNA, 357 bp, Artificial
  MsCOMT deletion introduced by TALEN pair MsCOMT_T01.1
tctcaaaaactcatcaatcacaaccatgggttcaacaggtgacactcaactaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9808 - DNA, 357 bp, Artificial
  MsCOMT deletion introduced by TALEN pair MsCOMT_T01.1
tctcaaaaacctcatcaatcacaaccatgggttcaacaggtgcaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9809 - DNA, 350 bp, Artificial
  MsCOMT deletion introduced by TALEN pair MsCOMT_T01.1
tctcaaaaacctcatcaatcacaaccatgggttcaacaggtgcaaacccacatatcagatgaataagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9810 - DNA, 348 bp, Artificial
  MsCOMT deletion introduced by TALEN pair MsCOMT_T01.1
tctcaaaaacctcatcaatcacaaccatgggttcaacaggtgaaactcaatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9811 - DNA, 358 bp, Artificial
  MsCOMT deletion introduced by TALEN pair MsCOMT_T01.1
tctcaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaataactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9812 - DNA, 358 bp, Artificial
  MsCOMT deletion introduced by TALEN pair MsCOMT_T01.1
tctcaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 9813 - DNA, 358 bp, Artificial
  MsCOMT deletion introduced by TALEN pair MsCOMT_T01.1
tctcaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9814 - DNA, 358 bp, Artificial
  MsCOMT deletion introduced by TALEN pair MsCOMT_T01.1
tctcaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9815 - DNA, 362 bp, Artificial
  MsCOMT deletion introduced by TALEN pair MsCOMT_T01.1
tctcaaaaacctcatcaatcacaaccatgggttcaacaggtgaaactcaaataaccaacccacatatcagatgaagaagcaaccctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9816 - DNA, 362 bp, Artificial
  MsCOMT deletion introduced by TALEN pair MsCOMT_T01.1
tctcaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9817 - DNA, 362 bp, Artificial
  MsCOMT deletion introduced by TALEN pair MsCOMT_T01.1
tctcaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9818 - DNA, 359 bp, Artificial
  MsCOMT deletion introduced by TALEN pair MsCOMT_T01.1
tctcaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9819 - DNA, 355 bp, Artificial
  MsCOMT deletion introduced by TALEN pair MsCOMT_T01.1
tctcaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 9820 - DNA, 362 bp, Artificial
  MsCOMT deletion introduced by TALEN pair MsCOMT_T01.1
tctcaaaaaactcatcaatcacaaccatgggttcaacaggtgcaactcacataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9821 - DNA, 359 bp, Artificial
  MsCOMT deletion introduced by TALEN pair MsCOMT_T01.1
tctcaaaaaacctcctcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9822 - DNA, 360 bp, Artificial
  MsCOMT deletion introduced by TALEN pair MsCOMT_T01.1
tctcaaaaaacctcctcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9823 - DNA, 332 bp, Artificial
  MsCOMT deletion introduced by TALEN pair MsCOMT_T01.1
tctcaaaaaacctcatcaatcacaaccatgggttcaacaggtgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9824 - DNA, 353 bp, Artificial
  MsCOMT deletion introduced by TALEN pair MsCOMT_T01.1
tctcaaaaaacctcatcaatcacaaccatgggttcaacaggtgaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcatgttacaatatcctcacttgttcagttcgtactcaacaagatggaaaggttcagagactttatggtttggctactgttgctaa

SEQ ID NO: 9825 - DNA, 355 bp, Artificial
  MsCOMT deletion introduced by TALEN pair MsCOMT_T01.1
tctcaaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9826 - DNA, 355 bp, Artificial
  MsCOMT deletion introduced by TALEN pair MsCOMT_T01.1
tctcaaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9827 - DNA, 355 bp, Artificial
  MsCOMT deletion introduced by TALEN pair MsCOMT_T01.1
tctcaaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatgtcctcacttgttcagttcgtactcaacaagatggaaaggttcagagactttatggtttggctactgttgctaa

SEQ ID NO: 9828 - DNA, 359 bp, Artificial
  MsCOMT deletion introduced by TALEN pair MsCOMT_T01.1
tctcaaaaaacctcatcaatcacaaccatgggttcaacaggtgaaactcaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9829 - DNA, 361 bp, Artificial
  MsCOMT deletion introduced by TALEN pair MsCOMT_T01.1
tctcaaaaaacctcatcaatcacaaccatgggttcaacaggtgaaactcaaattcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9830 - DNA, 433 bp, Artificial
  MsCOMT deletion introduced by TALEN pair MsCOMT_T01.1
tctcaaaaaacctcatcaatcacaaccatgggttcaacaggtgaaactcaaatggcacagcaccggcaacagcgcctgcaccgtctccagcgcctgcttgccaccaatattgctggcgatggccaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9831 - DNA, 357 bp, Artificial
  MsCOMT deletion introduced by TALEN pair MsCOMT_T01.1
tctcaaaaaacctcatcaatcacaaccatgggttcaacaggtgaaactcaaatcccacatatcagatgaagaagcaaacctcttcgccctgcaattagcaagtgcttcagttcttcccatgattttaaaagcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaacgttcagagactttatggtttggctactgttgctaa

SEQ ID NO: 9832 - DNA, 359 bp, Artificial
  MsCOMT deletion introduced by TALEN pair MsCOMT_T01.1
tctcaaaaaacctcatcaatcacaaccatgggttcaacaggtgaaactcaaatcacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9833 - DNA, 362 bp, Artificial
  MsCOMT deletion introduced by TALEN pair MsCOMT_T01.1
tctcaaaaaacctcatcaatcacaaccatgggttcaacaggtgaaactcaaatcacaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 9834 - DNA, 360 bp, Artificial
  MsCOMT deletion introduced by TALEN pair MsCOMT_T01.1
tctcaaaaaacctcatcaatcacaaccatgggttcaacaggtgaaactcaaatcaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9835 - DNA, 358 bp, Artificial
  MsCOMT deletion introduced by TALEN pair MsCOMT_T01.1
tctcaaaaaacctcatcaatcacaaccatgggttcaacaggtgaaactcaaatacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9836 - DNA, 358 bp, Artificial
  MsCOMT deletion introduced by TALEN pair MsCOMT_T01.1
tctcaaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9837 - DNA, 358 bp, Artificial
  MsCOMT deletion introduced by TALEN pair MsCOMT_T01.1
tctcaaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9838 - DNA, 357 bp, Artificial
  MsCOMT deletion introduced by TALEN pair MsCOMT_T01.1
tctcaaaaaacctcatcaatcacaaccatgggttcaacaggtgaaactcaaataccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9839 - DNA, 362 bp, Artificial
  MsCOMT deletion introduced by TALEN pair MsCOMT_T01.1
tctcaaaaaacctcatcaatcacaaccatgggttcaacaggtgaaactcaaataccaacccacatatcagatgaagaagcaaccctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9840 - DNA, 362 bp, Artificial
  MsCOMT deletion introduced by TALEN pair MsCOMT_T01.1
tctcaaaaaacctcatcaatcacaaccatgggttcaacaggtgaaactcaaataccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9841 - DNA, 353 bp, Artificial
  MsCOMT deletion introduced by TALEN pair MsCOMT_T01.1
tctcaaaaaacctcatcaatcacaaccatgggttcaacaggtgaaactcaaataatatcagatgaagaagcaaacctcttcgccatgcaattagcaattgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9842 - DNA, 359 bp, Artificial
  MsCOMT deletion introduced by TALEN pair MsCOMT_T01.1
tctcaaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9843 - DNA, 359 bp, Artificial
  MsCOMT deletion introduced by TALEN pair MsCOMT_T01.1
tctcaaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9844 - DNA, 359 bp, Artificial
  MsCOMT deletion introduced by TALEN pair MsCOMT_T01.1
tctcaaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9845 - DNA, 359 bp, Artificial
  MsCOMT deletion introduced by TALEN pair MsCOMT_T01.1
tctcaaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9846 - DNA, 359 bp, Artificial
  MsCOMT deletion introduced by TALEN pair MsCOMT_T01.1
tctcaaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9847 - DNA, 363 bp, Artificial
  MsCOMT deletion introduced by TALEN pair MsCOMT_T01.1
tctcaaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9848 - DNA, 363 bp, Artificial
  MsCOMT deletion introduced by TALEN pair MsCOMT_T01.1
tctcaaaaaacctcatcaatcacaaccatgggttcaacaggtgaaactcaaataaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9849 - DNA, 445 bp, Artificial
  MsCOMT deletion introduced by TALEN pair MsCOMT_T01.1
tctcaaaaaacctcatcaatcacaaccatgggttcaacaggtgaaactcaaataacagttggtgatgtggttcagcctggtcagctgggccttgtagttgcccttgaagtggccggacacgcacaggaacttgaacaccaacccacatatcagatgaagaagcaaacctcttcgccatgcaattagcaagtgcttcagttcttcccatgattttaaaatcagctcttgaacttgatctcttagaaatcatttctaaagctggacctggtgctcaaatttcgcctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9850 - DNA, 445 bp, Artificial
  MsCOMT deletion introduced by TALEN pair MsCOMT_T01.1
tctcaaaaaacctcatcaatcacaaccatgggttcaacaggtgaaactcaaataacagttggtgatgtggttcagcctggtcagctgggccttgtagttgcccttgaagtggccggacacgaacaggaacttgaacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcatctatttaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9851 - DNA, 362 bp, Artificial
  MsCOMT deletion introduced by TALEN pair MsCOMT_T01.1
tctcaaaaaacctcatcaatcacaaccatgggttcaacaggtgaaactcaaataacaacccacatatcagatgaagaagcaaccctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9852 - DNA, 362 bp, Artificial
  MsCOMT deletion introduced by TALEN pair MsCOMT_T01.1
tctcaaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9853 - DNA, 360 bp, Artificial
  MsCOMT deletion introduced by TALEN pair MsCOMT_T01.1
tctcaaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcgacaagatggaaaggttcagagactttatggtttggctactgttgctaa

SEQ ID NO: 9854 - DNA, 360 bp, Artificial
  MsCOMT deletion introduced by TALEN pair MsCOMT_T01.1
tctcaaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9855 - DNA, 361 bp, Artificial
  MsCOMT deletion introduced by TALEN pair MsCOMT_T01.1
tctcaaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9856 - DNA, 361 bp, Artificial
  MsCOMT deletion introduced by TALEN pair MsCOMT_T01.1
tctcaaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9857 - DNA, 361 bp, Artificial
  MsCOMT deletion introduced by TALEN pair MsCOMT_T01.1
tctcaaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9858 - DNA, 356 bp, Artificial
  MsCOMT deletion introduced by TALEN pair MsCOMT_T01.1
tctcaaaaaacctcatcaatcacaaccatgggttcaacaggtgaaactcaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcactcgttcagttcgtactcaacaagatggaaaagttcagagactttatggtttggctactgttgctaa

SEQ ID NO: 9859 - DNA, 356 bp, Artificial
  MsCOMT deletion introduced by TALEN pair MsCOMT_T01.1
tctcaaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 9860 - DNA, 356 bp, Artificial
  MsCOMT deletion introduced by TALEN pair MsCOMT_T01.1
tctcaaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9861 - DNA, 356 bp, Artificial
  MsCOMT deletion introduced by TALEN pair MsCOMT_T01.1
tctcaaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9862 - DNA, 356 bp, Artificial
  MsCOMT deletion introduced by TALEN pair MsCOMT_T01.1
tctcaaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9863 - DNA, 360 bp, Artificial
  MsCOMT deletion introduced by TALEN pair MsCOMT_T01.1
tctcaaaaaacctcatcaatcacaaccatgggttcaacaggtgaaactcaaaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9864 - DNA, 359 bp, Artificial
  MsCOMT deletion introduced by TALEN pair MsCOMT_T01.1
tctcaaaaaacctcatcaatcacaaccatgggttcaacaggtgaaactcaaacaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 9865 - DNA, 359 bp, Artificial
  MsCOMT deletion introduced by TALEN pair MsCOMT_T01.1
tctcaaaaaacctcatcaatcacaaccatgggttcaacaggtgaaactcaaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9866 - DNA, 357 bp, Artificial
  MsCOMT deletion introduced by TALEN pair MsCOMT_T01.1
tctcaaaaaacctcatcaatcacaaccatgggttcaacaggtgaaactcaaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9867 - DNA, 357 bp, Artificial
  MsCOMT deletion introduced by TALEN pair MsCOMT_T01.1
tctcaaaaaacctcatcaatcacaaccatgggttcaacaggtgaaactcaaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9868 - DNA, 357 bp, Artificial
  MsCOMT deletion introduced by TALEN pair MsCOMT_T01.1
tctcaaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9869 - DNA, 357 bp, Artificial
  MsCOMT deletion introduced by TALEN pair MsCOMT_T01.1
tctcaaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9870 - DNA, 357 bp, Artificial
  MsCOMT deletion introduced by TALEN pair MsCOMT_T01.1
tctcaaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9871 - DNA, 357 bp, Artificial
  MsCOMT deletion introduced by TALEN pair MsCOMT_T01.1
tctcaaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9872 - DNA, 350 bp, Artificial
  MsCOMT deletion introduced by TALEN pair MsCOMT_T01.1
tctcaaaaaacctcatcaatcacaaccatgggttcaacaggtgaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagccaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9873 - DNA, 350 bp, Artificial
  MsCOMT deletion introduced by TALEN pair MsCOMT_T01.1
tctcaaaaaacctcatcaatcacaaccatgggttcaacaggtgaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9874 - DNA, 353 bp, Artificial
  MsCOMT deletion introduced by TALEN pair MsCOMT_T01.1
tctcaaaaaacctcatcaatcacaaccatgggttcaacaggtgaaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaagattcagagactttatggtttggctactgttttaa

SEQ ID NO: 9875 - DNA, 343 bp, Artificial
  MsCOMT deletion introduced by TALEN pair MsCOMT_T01.1
tctcaaaaaacctcatcaatcacaaccatgggttcaacacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatgggttggctactgttgctaa

SEQ ID NO: 9876 - DNA, 361 bp, Artificial
  MsCOMT deletion introduced by TALEN pair MsCOMT_T01.1
tctcaaaaaacctatcaatcacaaccatgggttcaacaggtgacactcaaataacaacccacatatcagatgaagaagcaaacctcttcgccatgcaattagcaagtgcttcagttcttcccatgattttaaaatcagctcttgaacttgatctcttagaaatcattgctaaagctggatctggtgctcaaatttcacctgttcaaaatgcttctcatcttccaacaactaaccctgatgcacctgtcatgttggaccgaatgttgcgcctcttggctttttactatatcctatcttattctgtttgtactcaacaagatggaaaggttcagagactttatggtttggctactgttgctaa

SEQ ID NO: 9877 - DNA, 349 bp, Artificial
  MsCOMT deletion introduced by TALEN pair MsCOMT_T01.1
tctcaaaaaaacctcatcaatcacaaccatgggttcaacaggtgaaacccacatatcagatgaagaagcaaacctcttcgccatgcaactagaaagggcattagtgcctcccatgagcttgaaataagctcttgaacttgaacttttagaaatcattgctaaagctggacttggtgctcaaatttcacctattgaaattgcttctcagctcccaacaactaaccctgatgcaccatttatgttgtaccgaattttacgtctcttggcttgttacaatatcctcacttgttcagttcgttctcaaccagctgtaaagattcagagactttatcttttttcctgttcctaa

SEQ ID NO: 9878 - DNA, 358 bp, Artificial
  MsCOMT deletion introduced by TALEN pair MsCOMT_T01.1
tctacaaaacctctcaatcacaaccatgggttcaacaggtgaaactcaactaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaatttcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9879 - DNA, 355 bp, Artificial
  MsCOMT deletion introduced by TALEN pair MsCOMT_T01.1
tctacaaaacctcatcaatcacaaccatgggttcaacaggtgaaactcaaacccacatatcagttgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9880 - DNA, 354 bp, Artificial
  MsCOMT deletion introduced by TALEN pair MsCOMT_T01.1
tctacaaaacctcaatcacaaccatgggttcaacaggtgaaactcaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9881 - DNA, 355 bp, Artificial
  MsCOMT deletion introduced by TALEN pair MsCOMT_T01.1
tctacaaaaactcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9882 - DNA, 362 bp, Artificial
  MsCOMT deletion introduced by TALEN pair MsCOMT_T01.1
tctacaaaaacctcctcaatcacaaccattggttcaacaggtgaaactccaataacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9883 - DNA, 362 bp, Artificial
  MsCOMT deletion introduced by TALEN pair MsCOMT_T01.1
tctacaaaaacctcctcaatcacaaccatgggttcaacaggtgaaactcaaataccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9884 - DNA, 246 bp, Artificial
  MsCOMT deletion introduced by TALEN pair MsCOMT_T01.1
tctacaaaaacctcatcaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9885 - DNA, 332 bp, Artificial
  MsCOMT deletion introduced by TALEN pair MsCOMT_T01.1
tctacaaaaacctcatcaatcacaaccatgggttcaacaggtgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttacggtttggctactgttgctaa

SEQ ID NO: 9886 - DNA, 349 bp, Artificial
  MsCOMT deletion introduced by TALEN pair MsCOMT_T01.1
tctacaaaaacctcatcaatcacaaccatgggttcaacaggtgaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9887 - DNA, 363 bp, Artificial
  MsCOMT deletion introduced by TALEN pair MsCOMT_T01.1
tctacaaaaacctcatcaatcacaaccatgggttcaacaggtgaaactcgaataacaaacccacatatcagatgaagaagcacacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 9888 - DNA, 344 bp, Artificial
  MsCOMT deletion introduced by TALEN pair MsCOMT_T01.1
tctacaaaaacctcatcaatcacaaccatgggttcaacaggtgaaactccagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9889 - DNA, 358 bp, Artificial
  MsCOMT deletion introduced by TALEN pair MsCOMT_T01.1
tctacaaaaacctcatcaatcacaaccatgggttcaacaggtgaaactcaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9890 - DNA, 355 bp, Artificial
  MsCOMT deletion introduced by TALEN pair MsCOMT_T01.1
tctacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9891 - DNA, 358 bp, Artificial
  MsCOMT deletion introduced by TALEN pair MsCOMT_T01.1
tctacaaaaacctcatcaatcacaaccatgggttcaacaggtgaaactcaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9892 - DNA, 433 bp, Artificial
  MsCOMT deletion introduced by TALEN pair MsCOMT_T01.1
tctacaaaaacctcatcaatcacaaccatgggttcaacaggtgaaactcaaatggcacagcaccggcaacagccgctggaccgtctccagcgcctgcttgccaccgccattgctggcgatggccaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9893 - DNA, 361 bp, Artificial
  MsCOMT deletion introduced by TALEN pair MsCOMT_T01.1
tctacaaaaacctcatcaatcacaaccatgggttcaacaggtgaaactcaaatccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9894 - DNA, 361 bp, Artificial
  MsCOMT deletion introduced by TALEN pair MsCOMT_T01.1
tctacaaaaacctcatcaatcacaaccatgggttcaacaggtgaaactcaaatcatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9895 - DNA, 360 bp, Artificial
  MsCOMT deletion introduced by TALEN pair MsCOMT_T01.1
tctacaaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9896 - DNA, 358 bp, Artificial
  MsCOMT deletion introduced by TALEN pair MsCOMT_T01.1
tctacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9897 - DNA, 358 bp, Artificial
  MsCOMT deletion introduced by TALEN pair MsCOMT_T01.1
tctacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9898 - DNA, 359 bp, Artificial
  MsCOMT deletion introduced by TALEN pair MsCOMT_T01.1
tctacaaaaacctcatcaatcacaaccatgggttcaacaggtgaaactcaaataacccacatattagatgaagaagcaaacctcttcgccatgcaattagcaagtgcttcagttcttcccatgattttaaaatcagctcttaaacttgatctcttagaaatcattgctaaagctggacctggtgttcaaatttcacctattgaaattgcttctcagctcccaacaactaaccctgatgcaccagttatgttggaccgaatgttgcgtctcttggcttgttacaatatcctcacttgttcagttcgtaatcaacaagatggaaagattcagagactttatggtttggctactgttgctaa

SEQ ID NO: 9899 - DNA, 359 bp, Artificial
  MsCOMT deletion introduced by TALEN pair MsCOMT_T01.1
tctacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 9900 - DNA, 359 bp, Artificial
  MsCOMT deletion introduced by TALEN pair MsCOMT_T01.1
tctacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9901 - DNA, 359 bp, Artificial
  MsCOMT deletion introduced by TALEN pair MsCOMT_T01.1
tctacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 9902 - DNA, 359 bp, Artificial
  MsCOMT deletion introduced by TALEN pair MsCOMT_T01.1
tctacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9903 - DNA, 359 bp, Artificial
  MsCOMT deletion introduced by TALEN pair MsCOMT_T01.1
tctacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9904 - DNA, 359 bp, Artificial
  MsCOMT deletion introduced by TALEN pair MsCOMT_T01.1
tctacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9905 - DNA, 359 bp, Artificial
  MsCOMT deletion introduced by TALEN pair MsCOMT_T01.1
tctacaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9906 - DNA, 363 bp, Artificial
  MsCOMT deletion introduced by TALEN pair MsCOMT_T01.1
tctacaaaaacctcatcaatcacaaccatgggttcaacaggtgaaactcaaataaccaacccacatatcagatgaagaagcacacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9907 - DNA, 363 bp, Artificial
  MsCOMT deletion introduced by TALEN pair MsCOMT_T01.1
tctacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggaccttgtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggtccagagactttatggtttggctactgttgctaa

SEQ ID NO: 9908 - DNA, 363 bp, Artificial
  MsCOMT deletion introduced by TALEN pair MsCOMT_T01.1
tctacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9909 - DNA, 363 bp, Artificial
  MsCOMT deletion introduced by TALEN pair MsCOMT_T01.1
tctacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgaggctaa

SEQ ID NO: 9910 - DNA, 363 bp, Artificial
  MsCOMT deletion introduced by TALEN pair MsCOMT_T01.1
tctacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9911 - DNA, 363 bp, Artificial
  MsCOMT deletion introduced by TALEN pair MsCOMT_T01.1
tctacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9912 - DNA, 363 bp, Artificial
  MsCOMT deletion introduced by TALEN pair MsCOMT_T01.1
tctacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9913 - DNA, 445 bp, Artificial
  MsCOMT deletion introduced by TALEN pair MsCOMT_T01.1
tctacaaaaacctcatcaatcacaaccatgggttcaacaggtgaaactcaaataacagttggtgatgtggttcagcctggtcagctgggccttgtagttgcccttgaagtggccggacacgaacaggaacttgaacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9914 - DNA, 361 bp, Artificial
  MsCOMT deletion introduced by TALEN pair MsCOMT_T01.1
tctacaaaaacctcatcaatcacaaccatgggttcaacaggtgaaactcaaataaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtcacttggcttgttacaatatcctcacttgttcagttcgtactcaacaagatggaaagattcagagactttatggtttggctactgttgctaa

SEQ ID NO: 9915 - DNA, 361 bp, Artificial
  MsCOMT deletion introduced by TALEN pair MsCOMT_T01.1
tctacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9916 - DNA, 423 bp, Artificial
  MsCOMT deletion introduced by TALEN pair MsCOMT_T01.1
tctacaaaaacctcatcaatcacaaccatgggttcaacaggtgaaactcaaagacacgacttatcgccactggcagcagccactggtaacaggattagcagagcgaggtatgtaggcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9917 - DNA, 356 bp, Artificial
  MsCOMT deletion introduced by TALEN pair MsCOMT_T01.1
tctacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9918 - DNA, 356 bp, Artificial
  MsCOMT deletion introduced by TALEN pair MsCOMT_T01.1
tctacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9919 - DNA, 356 bp, Artificial
  MsCOMT deletion introduced by TALEN pair MsCOMT_T01.1
tctacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9920 - DNA, 356 bp, Artificial
  MsCOMT deletion introduced by TALEN pair MsCOMT_T01.1
tctacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9921 - DNA, 357 bp, Artificial
  MsCOMT deletion introduced by TALEN pair MsCOMT_T01.1
tctacaaaaacctcatcaatcacaaccatgggttcaacaggtgaaactcaaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9922 - DNA, 357 bp, Artificial
  MsCOMT deletion introduced by TALEN pair MsCOMT_T01.1
tctacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttagcttgttacaatatcctcacttgttcagttcgtactcaacaagatggaaaagttcagagactttatggtttggctactgttgctaa

SEQ ID NO: 9923 - DNA, 357 bp, Artificial
  MsCOMT deletion introduced by TALEN pair MsCOMT_T01.1
tctacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9924 - DNA, 357 bp, Artificial
  MsCOMT deletion introduced by TALEN pair MsCOMT_T01.1
tctacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9925 - DNA, 354 bp, Artificial
  MsCOMT deletion introduced by TALEN pair MsCOMT_T01.1
tctacaaaaacctcatcaatcacaaccatgggttcaacaggtgaaactcaaaaacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9926 - DNA, 350 bp, Artificial
  MsCOMT deletion introduced by TALEN pair MsCOMT_T01.1
tctacaaaaacctcatcaatcacaaccatgggttcaacaggtgaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgtgctaa

SEQ ID NO: 9927 - DNA, 343 bp, Artificial
  MsCOMT deletion introduced by TALEN pair MsCOMT_T01.1
tctacaaaaacctcatcaatcacaaccatgggttcaacacccccatatcagatgaagaagcaaccctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9928 - DNA, 356 bp, Artificial
  MsCOMT deletion introduced by TALEN pair MsCOMT_T01.1
tctacaaaaacctatcaatcacaaccatgggttcaacaggtgcaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9929 - DNA, 358 bp, Artificial
  MsCOMT deletion introduced by TALEN pair MsCOMT_T01.1
tctaacctcatcaatcacaaccatgggttcaacaggtgaaactcaaataaccaacccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9930 - DNA, 363 bp, Artificial
  MsCOMT deletion introduced by TALEN pair MsCOMT_T01.1
tctaacaaaaacctcatcaatcacaaccatgggttcaacaggtgaaactcaaataccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9931 - DNA, 357 bp, Artificial
  MsCOMT deletion introduced by TALEN pair MsCOMT_T01.1
tctaacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9932 - DNA, 358 bp, Artificial
  MsCOMT deletion introduced by TALEN pair MsCOMT_T01.1
tctaacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9933 - DNA, 347 bp, Artificial
  MsCOMT deletion introduced by TALEN pair MsCOMT_T01.1
tctaaacctcatcaatcacaaccattggttcaacaggtgaaaacccacatatcagatgaagaagcaaacctcttcgccatgcaattagcaattgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9934 - DNA, 357 bp, Artificial
  MsCOMT deletion introduced by TALEN pair MsCOMT_T01.1
tctaaaaacctcatcaatcacaaccatgggttcaacaggtgacactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9935 - DNA, 354 bp, Artificial
  MsCOMT deletion introduced by TALEN pair MsCOMT_T01.1
tctaaaaacctcatcaatcacaaccatgggttcaacaggtgacactcaaacccacatatcagatgaagaagcaaacctcttcgccatgcaattagcaattgcttcagttcttcccatgattttaaaatcagctctcgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9936 - DNA, 357 bp, Artificial
  MsCOMT deletion introduced by TALEN pair MsCOMT_T01.1
tctaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9937 - DNA, 355 bp, Artificial
  MsCOMT deletion introduced by TALEN pair MsCOMT_T01.1
tctaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9938 - DNA, 358 bp, Artificial
  MsCOMT deletion introduced by TALEN pair MsCOMT_T01.1
tctaaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9939 - DNA, 361 bp, Artificial
  MsCOMT deletion introduced by TALEN pair MsCOMT_T01.1
tcgcacaaaaacctcatcaatcacaaacatgggttcaacaggtgaaactcaaatcaacccacatatcagatgaagaagcaaacctcttcgccatgcaactagcaagtgcttcagttcttaccatgattttgaaatcagctcttgaacttgatctctttgaaatcattgctaaagctggacctggtgctcaaatttggcctattgaaattgcttctcaactcccaacaactaaccctgatgcaccagttatgttggaccgaatgttgcgtctcttggcttgttacaatatcctcccttgttcagttcgtacccaacaagatggaaaggttcagagacattatggtttggctactgttgctaa

SEQ ID NO: 9940 - DNA, 359 bp, Artificial
  MsCOMT deletion introduced by TALEN pair MsCOMT_T01.1
tcctcacaaaaacctcatcaatcacaaccatgggttcaacaggtgaaactcaactaccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9941 - DNA, 352 bp, Artificial
  MsCOMT deletion introduced by TALEN pair MsCOMT_T01.1
tcccacaaaaacctcatcaatcacaaccatgggttcaacaggtgaaactccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcatcacttgttcagttcgtactcaacaagatggaaagattcagagactttatggtttggctactgttgctaa

SEQ ID NO: 9942 - DNA, 361 bp, Artificial
  MsCOMT deletion introduced by TALEN pair MsCOMT_T01.1
tcccacaaaaacctcatcaatcacaaccatgggttcaacaggtgaaactcaaattaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9943 - DNA, 359 bp, Artificial
  MsCOMT deletion introduced by TALEN pair MsCOMT_T01.1
tcccacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9944 - DNA, 359 bp, Artificial
  MsCOMT deletion introduced by TALEN pair MsCOMT_T01.1
tcccacaaaaacctcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9945 - DNA, 363 bp, Artificial
  MsCOMT deletion introduced by TALEN pair MsCOMT_T01.1
tcccacaaaaacctcatcaatcacaaccatgggttcaacaggtgaaactcaaataccaacccacatatcagatgaagaagcaaacctcttcgccatgcaattagcaagtgcttcagttcttcccatgattttaaaatcagctcttgaacttgatctcttagaaatcattgctaaagctggacctggtgctaaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9946 - DNA, 445 bp, Artificial
  MsCOMT deletion introduced by TALEN pair MsCOMT_T01.1
tcccacaaaaacctcatcaatcacaaccatgggttcaacaggtgaaactcaaataatggtggcaagcaggcgccggagacggtccagcggctgttgccggtgctgtgccaggcccacggcttgaccccggagcaggtccaacccacatatcagatgaagaagcaaacctcttcgccatgcaattagcaagtgcttcagttcttcccatgattttgagatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9947 - DNA, 359 bp, Artificial
  MsCOMT deletion introduced by TALEN pair MsCOMT_T01.1
tcccacaaaaacctcatcaatcacaaccatgggttcaacaggtgaaactcaaataacccacatatcagatgaagaagcaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9948 - DNA, 360 bp, Artificial
  MsCOMT deletion introduced by TALEN pair MsCOMT_T01.1
tcccacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttgtcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9949 - DNA, 360 bp, Artificial
  MsCOMT deletion introduced by TALEN pair MsCOMT_T01.1
tcccacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9950 - DNA, 364 bp, Artificial
  MsCOMT deletion introduced by TALEN pair MsCOMT_T01.1
tcccacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9951 - DNA, 363 bp, Artificial
  MsCOMT deletion introduced by TALEN pair MsCOMT_T01.1
tcccacaaaaacctcatcaatcacaaccatgggttcaacaggtgaaactcaaataacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9952 - DNA, 351 bp, Artificial
  MsCOMT deletion introduced by TALEN pair MsCOMT_T01.1
tcccacaaaaacctcatcaatcacaaccatgggttcaacaggtgaaacccacatatcatatgaagaagcaaacctcttcgccctgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9953 - DNA, 353 bp, Artificial
  MsCOMT deletion introduced by TALEN pair MsCOMT_T01.1
tcccacaaaaacctcatcaatcacaaccatgggttcaacaggtgaaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9954 - DNA, 357 bp, Artificial
  MsCOMT deletion introduced by TALEN pair MsCOMT_T01.1
tcccaaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9955 - DNA, 344 bp, Artificial
  MsCOMT deletion introduced by TALEN pair MsCOMT_T01.1
tccatcaatcacaaccatgggttcaacaggtgaaactcaacctacatatcagatgaagaagcaaacctcttcgccatgcaactagcaagtgcttcagttcttcccatgattttgaaatcagctcttgaacttgatctcttagaaatcattgctaaagctggacctggtgcacaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9956 - DNA, 387 bp, Artificial
  MsCOMT deletion introduced by TALEN pair MsCOMT_T01.1
tccacaaacctcatcaatcacaaccatgggttcaacaggtgaaactcaaataacccccagcaggtggtggccaccgccagcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9957 - DNA, 355 bp, Artificial
  MsCOMT deletion introduced by TALEN pair MsCOMT_T01.1
tccacaaaaacctcatcaatcacaaccatgggttcaacaggtgaaatccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9958 - DNA, 355 bp, Artificial
  MsCOMT deletion introduced by TALEN pair MsCOMT_T01.1
tccacaaaaacctcatcaatcacaaccatgggttcaacaggtgaaactcaacccacatatcagatgaagaagcaaacctcttcgccatgcaactagcaagtgcttcagttcttcccatgattttaaaatcagctcttgaacttgatctcctagaaatcattgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9959 - DNA, 360 bp, Artificial
  MsCOMT deletion introduced by TALEN pair MsCOMT_T01.1
tccacaaaaacctcatcaatcacaaccatgggttcaacaggtgaaactcaaattaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcgacaagatggaaagattcagagactttatggtttggctactgttgctaa

SEQ ID NO: 9960 - DNA, 357 bp, Artificial
  MsCOMT deletion introduced by TALEN pair MsCOMT_T01.1
tccacaaaaacctcatcaatcacaaccatgggttcaacaggtgaaactcaaatcccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9961 - DNA, 356 bp, Artificial
  MsCOMT deletion introduced by TALEN pair MsCOMT_T01.1
tccacaaaaacctcatcaatcacaaccatgggttcaacaggtgaaactcaaatccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9962 - DNA, 350 bp, Artificial
  MsCOMT deletion introduced by TALEN pair MsCOMT_T01.1
tccacaaaaacctcatcaatcacaaccatgggttcaacaggtgaaactcaaatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 9963 - DNA, 358 bp, Artificial
  MsCOMT deletion introduced by TALEN pair MsCOMT_T01.1
tccacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggatcagagactttatggtttggctactgttgctaa

SEQ ID NO: 9964 - DNA, 359 bp, Artificial
  MsCOMT deletion introduced by TALEN pair MsCOMT_T01.1
tccacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9965 - DNA, 359 bp, Artificial
  MsCOMT deletion introduced by TALEN pair MsCOMT_T01.1
tccacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9966 - DNA, 363 bp, Artificial
  MsCOMT deletion introduced by TALEN pair MsCOMT_T01.1
tccacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9967 - DNA, 363 bp, Artificial
  MsCOMT deletion introduced by TALEN pair MsCOMT_T01.1
tccacaaaaacctcatcaatcacaaccatgggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9968 - DNA, 360 bp, Artificial
  MsCOMT deletion introduced by TALEN pair MsCOMT_T01.1
tccacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9969 - DNA, 356 bp, Artificial
  MsCOMT deletion introduced by TALEN pair MsCOMT_T01.1
tccacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 9970 - DNA, 356 bp, Artificial
  MsCOMT deletion introduced by TALEN pair MsCOMT_T01.1
tccacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9971 - DNA, 357 bp, Artificial
  MsCOMT deletion introduced by TALEN pair MsCOMT_T01.1
tccacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9972 - DNA, 350 bp, Artificial
  MsCOMT deletion introduced by TALEN pair MsCOMT_T01.1
tccacaaaaacctcatcaatcacaaccatgggttcaacaggtgaaacccacatctcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9973 - DNA, 311 bp, Artificial
  MsCOMT deletion introduced by TALEN pair MsCOMT_T01.1
tccacaaaaacctcatcaatcacaacagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9974 - DNA, 358 bp, Artificial
  MsCOMT deletion introduced by TALEN pair MsCOMT_T01.1
tccaaaaaactcatcaatcacaaccatgggttcaacaggtgaaacccaaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9975 - DNA, 359 bp, Artificial
  MsCOMT deletion introduced by TALEN pair MsCOMT_T01.1
tcacacaaaaacctcatcaatcacaaccatgggttcaacaggtgaaactcaaatacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9976 - DNA, 360 bp, Artificial
  MsCOMT deletion introduced by TALEN pair MsCOMT_T01.1
tcacacaaaaacctcatcaatcacaaccatgggttcaacaggtgaaactcaaataacccacatatcatatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgtttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9977 - DNA, 360 bp, Artificial
  MsCOMT deletion introduced by TALEN pair MsCOMT_T01.1
tcacacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9978 - DNA, 357 bp, Artificial
  MsCOMT deletion introduced by TALEN pair MsCOMT_T01.1
tcacacaaaaacctcatcaatcacaaccatgggttcaacaggtgaaactcaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9979 - DNA, 358 bp, Artificial
  MsCOMT deletion introduced by TALEN pair MsCOMT_T01.1
tcacaaaacctcatcaatcacaaccatgggttcaacaggtgaaactcaaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9980 - DNA, 335 bp, Artificial
  MsCOMT deletion introduced by TALEN pair MsCOMT_T01.1
tcacaaaaacctcatcaatcacaaccatgggttcacatatcagatgaagaagcaaacctcttctccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9981 - DNA, 358 bp, Artificial
  MsCOMT deletion introduced by TALEN pair MsCOMT_T01.1
tcacaaaaacctcatcaatcacaaccatgggttcaacaggtgcaactcaaataccccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9982 - DNA, 357 bp, Artificial
  MsCOMT deletion introduced by TALEN pair MsCOMT_T01.1
tcacaaaaacctcatcaatcacaaccatgggttcaacaggtgcaactcaaatacccacatatcagatgaagaagcaaacctcttcgccatgcaattatcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9983 - DNA, 358 bp, Artificial
  MsCOMT deletion introduced by TALEN pair MsCOMT_T01.1
tcacaaaaacctcatcaatcacaaccatgggttcaacaggtgcaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9984 - DNA, 361 bp, Artificial
  MsCOMT deletion introduced by TALEN pair MsCOMT_T01.1
tcacaaaaacctcatcaatcacaaccatgggttcaacaggtgaaactcaaataccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9985 - DNA, 358 bp, Artificial
  MsCOMT deletion introduced by TALEN pair MsCOMT_T01.1
tcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcggctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9986 - DNA, 356 bp, Artificial
  MsCOMT deletion introduced by TALEN pair MsCOMT_T01.1
tcacaaaaacctcatcaatcacaaccatgggttcaacaggtgaaactcaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9987 - DNA, 353 bp, Artificial
  MsCOMT deletion introduced by TALEN pair MsCOMT_T01.1
tcaacctcatcaatcacaaccatgggttcaacaggtgaaactcaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9988 - DNA, 356 bp, Artificial
  MsCOMT deletion introduced by TALEN pair MsCOMT_T01.1
tcaaaaacctcatcaatcacaaccatgggttcaacaggtgaaactcaaataacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9989 - DNA, 355 bp, Artificial
  MsCOMT deletion introduced by TALEN pair MsCOMT_T01.1
tatcacaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9990 - DNA, 337 bp, Artificial
  MsCOMT deletion introduced by TALEN pair MsCOMT_T01.1
tatcacaaaaacctcatcaatcacaaccatgggttcacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9991 - DNA, 360 bp, Artificial
  MsCOMT deletion introduced by TALEN pair MsCOMT_T01.1
tatcacaaaaacctcatcaatcacaaccatgggttcaacaggtgaaactcaaataacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9992 - DNA, 396 bp, Artificial
  MsCOMT deletion introduced by TALEN pair MsCOMT_T01.1
tatcacaaaaacctcatcaatcacaaccatgggttcaacaggtgaaactcaaataacagcaccggcaacagcgcctgcaccgtctccaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9993 - DNA, 361 bp, Artificial
  MsCOMT deletion introduced by TALEN pair MsCOMT_T01.1
tatcacaaaaacctcatcaatcacaaccatgggttcaacaggtgaaactcaaataaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9994 - DNA, 352 bp, Artificial
  MsCOMT deletion introduced by TALEN pair MsCOMT_T01.1
tatcacaaaaacctcatcaatcacaaccatgggttcaacaggtgaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 9995 - DNA, 358 bp, Artificial
  MsCOMT deletion introduced by TALEN pair MsCOMT_T01.1
tatcacaaaaacctcatcaatcacaaccaagggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9996 - DNA, 355 bp, Artificial
  MsCOMT deletion introduced by TALEN pair MsCOMT_T01.1
tatcacaaaaaactcatcaatcacaaacatgggttcaacaggtgaaactcaaacacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9997 - DNA, 350 bp, Artificial
  MsCOMT deletion introduced by TALEN pair MsCOMT_T01.1
taaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 9998 - DNA, 363 bp, Artificial
  MsCOMT deletion introduced by TALEN pair MsCOMT_T01.1
gtctcacaaaaacctcatcaatcacaaccatgggttcaacaggtgaaactcaactaaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 9999 - DNA, 357 bp, Artificial
  MsCOMT deletion introduced by TALEN pair MsCOMT_T01.1
gtctcacaaaaacctcatcaatcacaaccatgggttcaacaggtgaaactcaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10000 - DNA, 362 bp, Artificial
  MsCOMT deletion introduced by TALEN pair MsCOMT_T01.1
gtctcacaaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10001 - DNA, 362 bp, Artificial
  MsCOMT deletion introduced by TALEN pair MsCOMT_T01.1
gtctcacaaaaacctcatcaatcacaaccatgggttcaacaggtgaaactcaaatcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10002 - DNA, 361 bp, Artificial
  MsCOMT deletion introduced by TALEN pair MsCOMT_T01.1
gtctcacaaaaacctcatcaatcacaaccatgggttcaacaggtgaaactcaaataacccacatatcagatgaagaagcaaacctcttcgccatgcaattagcaattgcttcagttcttcccatgattttaaaatcagctcttgaacttgatctcttagaaatcattgctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 10003 - DNA, 361 bp, Artificial
  MsCOMT deletion introduced by TALEN pair MsCOMT_T01.1
gtctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10004 - DNA, 362 bp, Artificial
  MsCOMT deletion introduced by TALEN pair MsCOMT_T01.1
gtctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10005 - DNA, 363 bp, Artificial
  MsCOMT deletion introduced by TALEN pair MsCOMT_T01.1
gtctcacaaaaacctcatcaatcacaaccatgggttcaacaggtgaaactcaaataaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10006 - DNA, 358 bp, Artificial
  MsCOMT deletion introduced by TALEN pair MsCOMT_T01.1
gtctcacaaaaacctcatcaatcacaaccatgggttcaacaggtgaaactcaaacccacatatcagatgaagaagcaaacctcttcgccatgcaactagcaagtgcttcagttcttcccatgatttggaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10007 - DNA, 366 bp, Artificial
  MsCOMT deletion introduced by TALEN pair MsCOMT_T01.1
ggtcacaaaaacctcatcaatcacaaccatgggttcaacaggtgaaaccccccccacaccaacccacacctcctctccagaagcaaacctcttcgccatgcaattagcaagtgcttcagttcttcccatgattttaaaatcagctcttgaacttgatctcttagaaatcattgctaaagctggacctggggctcaaatttcacctattgaaattgcttctcagctaccaacaactaaccctgatgcaccagttatgctggaccgaatgttgcgtctcttggcttgttacaatatccgcacttgttcagttcgtactcaacaagatggaaaggtgaagagactttatggtttggctactgttgctaa

SEQ ID NO: 10008 - DNA, 354 bp, Artificial
  MsCOMT deletion introduced by TALEN pair MsCOMT_T01.1
gctcacaaaaacctcatcaatcacaaccatgggttcaacaggtgaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10009 - DNA, 360 bp, Artificial
  MsCOMT deletion introduced by TALEN pair MsCOMT_T01.1
gctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10010 - DNA, 351 bp, Artificial
  MsCOMT deletion introduced by TALEN pair MsCOMT_T01.1
gctcacaaaaacctcatcaatcacaaccatgggttcaacaggtgaaacccacatatcagatgaagaagcacccctccccgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctctttgcttgttacaatatcctcacttgttcagttcgtactcaacaagatggaaagatgcagagactttatggtttggctactgttgctaa

SEQ ID NO: 10011 - DNA, 360 bp, Artificial
  MsCOMT deletion introduced by TALEN pair MsCOMT_T01.1
gcgcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacgactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 10012 - DNA, 356 bp, Artificial
  MsCOMT deletion introduced by TALEN pair MsCOMT_T01.1
ctcacaaaactcatcaatcacaaccatgggttcaacaggtgaaactcaaatacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10013 - DNA, 363 bp, Artificial
  MsCOMT deletion introduced by TALEN pair MsCOMT_T01.1
ctcacaaaaacctcctcaatcacaaccattggttcaacaggtgaaactcaaataaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 10014 - DNA, 355 bp, Artificial
  MsCOMT deletion introduced by TALEN pair MsCOMT_T01.1
ctcacaaaaacctcatcaatcacaaccatgggttcaacaggtgaaactcaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10015 - DNA, 356 bp, Artificial
  MsCOMT deletion introduced by TALEN pair MsCOMT_T01.1
ctcacaaaaacctcatcaatcacaaccatgggttcaacaggtgaaactcaaatccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10016 - DNA, 350 bp, Artificial
  MsCOMT deletion introduced by TALEN pair MsCOMT_T01.1
ctcacaaaaacctcatcaatcacaaccatgggttcaacaggtgaaactcaaatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10017 - DNA, 359 bp, Artificial
  MsCOMT deletion introduced by TALEN pair MsCOMT_T01.1
ctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10018 - DNA, 359 bp, Artificial
  MsCOMT deletion introduced by TALEN pair MsCOMT_T01.1
ctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10019 - DNA, 359 bp, Artificial
  MsCOMT deletion introduced by TALEN pair MsCOMT_T01.1
ctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10020 - DNA, 392 bp, Artificial
  MsCOMT deletion introduced by TALEN pair MsCOMT_T01.1
ctcacaaaaacctcatcaatcacaaccatgggttcaacaggtgaaactcaaataaccaccgctggtagcggtggtttttttgtttgcacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10021 - DNA, 358 bp, Artificial
  MsCOMT deletion introduced by TALEN pair MsCOMT_T01.1
ctcacaaaaacctcatcaatcacaaccatgggttcaacaggtgaaactcaaataaccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10022 - DNA, 360 bp, Artificial
  MsCOMT deletion introduced by TALEN pair MsCOMT_T01.1
ctcacaaaaacctcatcaatcacaaccatgggttcaacaggtgaaactcaaataaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10023 - DNA, 356 bp, Artificial
  MsCOMT deletion introduced by TALEN pair MsCOMT_T01.1
ctcacaaaaacctcatcaatcacaaccatgggttcaacaggtgaaactcaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10024 - DNA, 356 bp, Artificial
  MsCOMT deletion introduced by TALEN pair MsCOMT_T01.1
ctcacaaaaacctcatcaatcacaaccatgggttcaacaggtgaaactcaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10025 - DNA, 357 bp, Artificial
  MsCOMT deletion introduced by TALEN pair MsCOMT_T01.1
ctcacaaaaacctcatcaatcacaaccatgggttcaacaggtgaaactcaaaacccacatatcagatgaagaagcaaacctcttcgccctgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10026 - DNA, 357 bp, Artificial
  MsCOMT deletion introduced by TALEN pair MsCOMT_T01.1
ctcacaaaaacctcatcaatcacaaccatgggttcaacaggtgaaactcaaaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10027 - DNA, 362 bp, Artificial
  MsCOMT deletion introduced by TALEN pair MsCOMT_T01.1
ctacaaaaacctcatcaatcacaaccatgggttcaacaggtgaaactcaaataaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10028 - DNA, 360 bp, Artificial
  MsCOMT deletion introduced by TALEN pair MsCOMT_T01.1
cctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10029 - DNA, 360 bp, Artificial
  MsCOMT deletion introduced by TALEN pair MsCOMT_T01.1
cctcacaaaaacctcatcaatcacaaccatgggttcaacaggtgaaactcaaataacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggatactgttgctaa

SEQ ID NO: 10030 - DNA, 360 bp, Artificial
  MsCOMT deletion introduced by TALEN pair MsCOMT_T01.1
cctcacaaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10031 - DNA, 364 bp, Artificial
  MsCOMT deletion introduced by TALEN pair MsCOMT_T01.1
cctcacaaaaacctcatcaatcacaaccatgggttcaacaggtgaaactcaaataaccaacccacatatcagatgaagaagccaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10032 - DNA, 358 bp, Artificial
  MsCOMT deletion introduced by TALEN pair MsCOMT_T01.1
cctcacaaaaacctcatcaatcacaaccatgggttcaacaggtgaaactcaaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10033 - DNA, 358 bp, Artificial
  MsCOMT deletion introduced by TALEN pair MsCOMT_T01.1
cctcacaaaaacctcatcaatcacaaccatgggttcaacaggtgaaactcaaaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaacccggatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10034 - DNA, 360 bp, Artificial
  MsCOMT deletion introduced by TALEN pair MsCOMT_T01.1
cctcacaaaaacctcatcaatcacaaccatgggttcaacaggtgaaactaaaataacccacatatcagatgaagaagcaaacctcttcgccatgtaactagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcccttgttcagttcgtactcaacaaggtggaaaagttcagagattttttggtttggctaatgttgctaa

SEQ ID NO: 10035 - DNA, 348 bp, Artificial
  MsCOMT deletion introduced by TALEN pair MsCOMT_T01.1
cctcacaaaaacctcatcaatcacaaccatgggttcaacaggtacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10036 - DNA, 355 bp, Artificial
  MsCOMT deletion introduced by TALEN pair MsCOMT_T01.1
ccaaaacctcatcaatcacaaccatgggttcaacaggtgaaactcaaatcacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10037 - DNA, 356 bp, Artificial
  MsCOMT deletion introduced by TALEN pair MsCOMT_T01.1
cacaaaaacctcatcaatcacaaccatgggttcaacaggtgaaactcaaaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10038 - DNA, 355 bp, Artificial
  MsCOMT deletion introduced by TALEN pair MsCOMT_T01.1
caaaaacctcatcaatcacaaccatgggttcaacaggtgaaactcaaataacccacatatcagatgaagaagcaaacctcttcgccatgcaactagcaagtgcttcagttcttcccatgattttgaaatcagctcttgaacttgatctcttagaaatcattgctgaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10039 - DNA, 356 bp, Artificial
  MsCOMT deletion introduced by TALEN pair MsCOMT_T02.1
tttcacagaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 10040 - DNA, 356 bp, Artificial
  MsCOMT deletion introduced by TALEN pair MsCOMT_T02.1
tttcacaaaaacctcatcaatcacaaccatgggttcaacaggtgaaactcagataacaccaacccacatatcagatgaagaagcaaacctcttcgccatgcaactagcaagtgcttcagttcttcccatgattttgaaatcagctcttgaacttgatctcttagaaattctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10041 - DNA, 362 bp, Artificial
  MsCOMT deletion introduced by TALEN pair MsCOMT_T02.1
tttcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10042 - DNA, 357 bp, Artificial
  MsCOMT deletion introduced by TALEN pair MsCOMT_T02.1
tttcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10043 - DNA, 352 bp, Artificial
  MsCOMT deletion introduced by TALEN pair MsCOMT_T02.1
tttcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10044 - DNA, 356 bp, Artificial
  MsCOMT deletion introduced by TALEN pair MsCOMT_T02.1
tttcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10045 - DNA, 312 bp, Artificial
  MsCOMT deletion introduced by TALEN pair MsCOMT_T02.1
tttcacaaaaacctcatcaatcacaaccatgggttcaacaggtgaaactcaaataacaccaacccacatatcagatgaagaagcaaacctcttcgccatgcaactagcaagtgcttcagttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10046 - DNA, 356 bp, Artificial
  MsCOMT deletion introduced by TALEN pair MsCOMT_T02.1
ttctcacaaaaacctcatcaatcacaaccatgggttcaacaggtgaaactcaactaacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10047 - DNA, 358 bp, Artificial
  MsCOMT deletion introduced by TALEN pair MsCOMT_T02.1
ttctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10048 - DNA, 220 bp, Artificial
  MsCOMT deletion introduced by TALEN pair MsCOMT_T02.1
ttccaaaaacctcatcaatcacaaccatgggttcaacaggtgaaactcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10049 - DNA, 359 bp, Artificial
  MsCOMT deletion introduced by TALEN pair MsCOMT_T02.1
ttccaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 10050 - DNA, 352 bp, Artificial
  MsCOMT deletion introduced by TALEN pair MsCOMT_T02.1
ttccaaaaacccatcaatcacaaccatgggttcaacaggtgaaactcaaataacaccaacccacatatcagatgaagaagcacacctcttcgccatgcaattagcaagtgcttcagttcttcccatgattttaaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10051 - DNA, 357 bp, Artificial
  MsCOMT deletion introduced by TALEN pair MsCOMT_T02.1
ttcacaaaacctcatcaatcacaaccatgggttcaacaggtgaaactcaaataacaccaacccacatatcagatgaagaagccaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10052 - DNA, 352 bp, Artificial
  MsCOMT deletion introduced by TALEN pair MsCOMT_T02.1
ttcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10053 - DNA, 360 bp, Artificial
  MsCOMT deletion introduced by TALEN pair MsCOMT_T02.1
ttcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10054 - DNA, 357 bp, Artificial
  MsCOMT deletion introduced by TALEN pair MsCOMT_T02.1
ttcacaaaaacctcctcaatcacaaccattggttcagcaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgcta

SEQ ID NO: 10055 - DNA, 354 bp, Artificial
  MsCOMT deletion introduced by TALEN pair MsCOMT_T02.1
ttcacaaaaacctcctcaatcacaaccatgggttcaacaggtgaaactcaaatcacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10056 - DNA, 356 bp, Artificial
  MsCOMT deletion introduced by TALEN pair MsCOMT_T02.1
ttcacaaaaacctcctcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 10057 - DNA, 359 bp, Artificial
  MsCOMT deletion introduced by TALEN pair MsCOMT_T02.1
ttcacaaaaacctcctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10058 - DNA, 357 bp, Artificial
  MsCOMT deletion introduced by TALEN pair MsCOMT_T02.1
ttcacaaaaacctcctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatctggacctggttctcaaatttcacctgttcaaattgcttctcagcttccaacaactaaccctgatgcactagtcatgttggaccgaatgttgcgtctcttggcttgttacaatatcctcacttgttctgttcgtactcaacaagatggaaaggttcagagactttatggtttggctactgttgctaa

SEQ ID NO: 10059 - DNA, 351 bp, Artificial
  MsCOMT deletion introduced by TALEN pair MsCOMT_T02.1
ttcacaaaaacctcctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10060 - DNA, 351 bp, Artificial
  MsCOMT deletion introduced by TALEN pair MsCOMT_T02.1
ttcacaaaaacctcatcaatcacaaccattggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttgctactgttgctaa

SEQ ID NO: 10061 - DNA, 356 bp, Artificial
  MsCOMT deletion introduced by TALEN pair MsCOMT_T02.1
ttcacaaaaacctcatcaatcacaaccattggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10062 - DNA, 359 bp, Artificial
  MsCOMT deletion introduced by TALEN pair MsCOMT_T02.1
ttcacaaaaacctcatcaatcacaaccatgggttcaacaggtgaaactccaatcacaccaacccacatatcagatgaagaagcaaacctcttcgccattcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatccttacttgttcagttcgtactcaacaagatggaaaggttcagagactttatggtttggctactgttgctaa

SEQ ID NO: 10063 - DNA, 221 bp, Artificial
  MsCOMT deletion introduced by TALEN pair MsCOMT_T02.1
ttcacaaaaacctcatcaatcacaaccatgggttcaacaggtgaaactcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10064 - DNA, 360 bp, Artificial
  MsCOMT deletion introduced by TALEN pair MsCOMT_T02.1
ttcacaaaaacctcatcaatcacaaccatgggttcaacaggtgaaactcaaatcacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10065 - DNA, 357 bp, Artificial
  MsCOMT deletion introduced by TALEN pair MsCOMT_T02.1
ttcacaaaaacctcatcaatcacaaccatgggttcaacaggtgaaactcaaatcacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10066 - DNA, 353 bp, Artificial
  MsCOMT deletion introduced by TALEN pair MsCOMT_T02.1
ttcacaaaaacctcatcaatcacaaccatgggttcaacaggtgaaactcaaatcacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10067 - DNA, 359 bp, Artificial
  MsCOMT deletion introduced by TALEN pair MsCOMT_T02.1
ttcacaaaaacctcatcaatcacaaccatgggttcaacaggtgaaactcaaatcacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10068 - DNA, 359 bp, Artificial
  MsCOMT deletion introduced by TALEN pair MsCOMT_T02.1
ttcacaaaaacctcatcaatcacaaccatgggttcaacaggtgaaactcaaatcacaccaacccacatatcagatgaagaagcaaacctcttcgccatgcaactagcaagtgcttcagttcttcccatgattttgaaatcagctcttgaacttgatctcttagaaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10069 - DNA, 356 bp, Artificial
  MsCOMT deletion introduced by TALEN pair MsCOMT_T02.1
ttcacaaaaacctcatcaatcacaaccatgggttcaacaggtgaaactcaaatcacaccaacccacatatcagatgaagaagcaaacctcttcgccatgcaactagcaagtgcttcagttcttcccatgattttaaaatcagctcttgaacttgatctcttagaaatctctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10070 - DNA, 216 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 10071 - DNA, 358 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgtcatgcaattagcaagtgcttcagttcttcccatgattttgaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10072 - DNA, 428 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccttgcaactagcaagtgcttcagttcttcccatgattttgaaatcagctcttgaacttgatctcttagaaatcattgccgccatcgtggctggcgatggccaccacctgctccggggtcaagccgtgggcctggcacaggctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10073 - DNA, 354 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttagaaatctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 10074 - DNA, 358 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10075 - DNA, 355 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10076 - DNA, 343 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10077 - DNA, 360 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10078 - DNA, 356 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10079 - DNA, 359 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10080 - DNA, 360 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10081 - DNA, 358 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10082 - DNA, 321 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10083 - DNA, 348 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgcta

SEQ ID NO: 10084 - DNA, 350 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10085 - DNA, 355 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10086 - DNA, 356 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaggctaaagctggacctggagctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgtgctaa

SEQ ID NO: 10087 - DNA, 353 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagccggacccggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10088 - DNA, 358 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagacggaaagattcagagactttatggtttggctactgttgctaa

SEQ ID NO: 10089 - DNA, 359 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10090 - DNA, 354 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10091 - DNA, 354 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10092 - DNA, 360 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10093 - DNA, 352 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10094 - DNA, 357 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10095 - DNA, 357 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10096 - DNA, 358 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 10097 - DNA, 354 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10098 - DNA, 354 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10099 - DNA, 354 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcacctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10100 - DNA, 359 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaactaaagctggacctggtgctcaaatttcacctattgaaattgcttctcagctaccaacaactaaccctgatgcaccagttatgttggaccgaatgttgcgtctcttggcttgctacaatatcctcacttgttcagttcgtactcaacaagatggaaaggttcagagactttatggtttggctactgttgctaa

SEQ ID NO: 10101 - DNA, 355 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10102 - DNA, 355 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10103 - DNA, 352 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 10104 - DNA, 350 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10105 - DNA, 351 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10106 - DNA, 305 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10107 - DNA, 334 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10108 - DNA, 259 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaattagcaagtgcttcagttcttcccataaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10109 - DNA, 355 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaactttatctcttagaaaagctagacctggtgctcaaatttcacctattgaaattgcttctcaactaccaacaactaaccctgatgcaccagttatgtttgaccgaattttgcgtctcttggcttgttacaatatcctcacttgttcatttcgtactcaacaagatataaaggttcagagactttatggtttccctactgttgctaa

SEQ ID NO: 10110 - DNA, 356 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10111 - DNA, 347 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10112 - DNA, 360 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaacattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10113 - DNA, 353 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10114 - DNA, 351 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10115 - DNA, 354 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10116 - DNA, 360 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10117 - DNA, 360 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10118 - DNA, 360 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgtttagttcgtactcaacaagatggaaaggttcagagactttatggtttggctactgttgctaa

SEQ ID NO: 10119 - DNA, 360 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10120 - DNA, 360 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10121 - DNA, 360 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10122 - DNA, 361 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10123 - DNA, 351 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10124 - DNA, 358 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10125 - DNA, 356 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10126 - DNA, 356 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10127 - DNA, 352 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcggagactttatggtttggctactgttgctaa

SEQ ID NO: 10128 - DNA, 345 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatcgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10129 - DNA, 294 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacctaccaacaactaaccctgatgcaccagttatgttggaccgaatgttgcgtctcttggcttgttacaatatcctcacttgttcagttcgtactcaacaagatggaaagattcagagactttatggtttggctactggtgctaa

SEQ ID NO: 10130 - DNA, 305 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10131 - DNA, 361 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10132 - DNA, 349 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10133 - DNA, 362 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10134 - DNA, 361 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 10135 - DNA, 358 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10136 - DNA, 354 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 10137 - DNA, 359 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatgcaaccagcaagtgcttcagttcttcccatgattttgaaatcagctcttgaacttgatctcttagaaattaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 10138 - DNA, 357 bp, Artificial
  MsCOMT deletion introduced by TALEN pair MsCOMT_T02.1
ttcacaaaaacctcatcaatcacaaccatgggttcaacaggtgaaactcaaataacaccaacccacatatcagatgaagaagcaaacctcttcgccatacaattagcaagtgcttcagttcttcccatgattttaaaatcagctcttgaacttgatctcttagaaatcagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10139 - DNA, 351 bp, Artificial
  MsCOMT deletion introduced by TALEN pair MsCOMT_T02.1
ttcacaaaaacctcatcaatcacaaccatgggttcaacaggtgaaactcaaataacaccaacccacacatcagatgaagaagcaaacctcttcgccattcaactagcaagtgcttcagttcttcccatgattttgaaatcagctcttgaacttgatctcttaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10140 - DNA, 353 bp, Artificial
  MsCOMT deletion introduced by TALEN pair MsCOMT_T02.1
ttcacaaaaacctcatcaatcacaacaatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 10141 - DNA, 357 bp, Artificial
  MsCOMT deletion introduced by TALEN pair MsCOMT_T02.1
ttcacaaaaacctcataatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgtgtctcttggcttgttacaatatcctcacttgttcagttcgtactcaacaagatggaaaggttcagagactttatggtttggctactgttgctaa

SEQ ID NO: 10142 - DNA, 361 bp, Artificial
  MsCOMT deletion introduced by TALEN pair MsCOMT_T02.1
ttcacaaaaacctcaacaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10143 - DNA, 352 bp, Artificial
  MsCOMT deletion introduced by TALEN pair MsCOMT_T02.1
ttcacaaaaacctatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10144 - DNA, 360 bp, Artificial
  MsCOMT deletion introduced by TALEN pair MsCOMT_T02.1
tgtcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10145 - DNA, 350 bp, Artificial
  MsCOMT deletion introduced by TALEN pair MsCOMT_T02.1
tgtcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10146 - DNA, 358 bp, Artificial
  MsCOMT deletion introduced by TALEN pair MsCOMT_T02.1
tgaaaaaaaacctcatcaatcacaaccatgggttcaacaggtgaaactcaaataacaccaacccacatatcagatgaagaagcaaacctcttcgccatgcaagtagcaagtgcttcagttcttcccatgattttgaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctta

SEQ ID NO: 10147 - DNA, 360 bp, Artificial
  MsCOMT deletion introduced by TALEN pair MsCOMT_T02.1
tcttcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10148 - DNA, 360 bp, Artificial
  MsCOMT deletion introduced by TALEN pair MsCOMT_T02.1
tcttacaaaaacctcatcaatcgcaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10149 - DNA, 312 bp, Artificial
  MsCOMT deletion introduced by TALEN pair MsCOMT_T02.1
tcttacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10150 - DNA, 345 bp, Artificial
  MsCOMT deletion introduced by TALEN pair MsCOMT_T02.1
tcttacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatcctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10151 - DNA, 360 bp, Artificial
  MsCOMT deletion introduced by TALEN pair MsCOMT_T02.1
tcttacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10152 - DNA, 359 bp, Artificial
  MsCOMT deletion introduced by TALEN pair MsCOMT_T02.1
tcttacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10153 - DNA, 356 bp, Artificial
  MsCOMT deletion introduced by TALEN pair MsCOMT_T02.1
tcttacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10154 - DNA, 357 bp, Artificial
  MsCOMT deletion introduced by TALEN pair MsCOMT_T02.1
tctgacgaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttggaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10155 - DNA, 359 bp, Artificial
  MsCOMT deletion introduced by TALEN pair MsCOMT_T02.1
tctgacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10156 - DNA, 354 bp, Artificial
  MsCOMT deletion introduced by TALEN pair MsCOMT_T02.1
tctctcatcaatcacaaccatgggttcaacaggtgaaactcacataacaccaacccacatatcagatgaagaagcaaacctcttcgccatgcaattagcaagtgcttcagttcttcccatgattttgaaatcagctcttgaacttgatctcttagaaatcattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10157 - DNA, 360 bp, Artificial
  MsCOMT deletion introduced by TALEN pair MsCOMT_T02.1
tctctcaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10158 - DNA, 361 bp, Artificial
  MsCOMT deletion introduced by TALEN pair MsCOMT_T02.1
tctctcaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10159 - DNA, 355 bp, Artificial
  MsCOMT deletion introduced by TALEN pair MsCOMT_T02.1
tctctcaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 10160 - DNA, 355 bp, Artificial
  MsCOMT deletion introduced by TALEN pair MsCOMT_T02.1
tctctcaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcaattgtgcagttcgtactcaacaagatggaaaggttcagagactttatggtctggatactgttgctaa

SEQ ID NO: 10161 - DNA, 352 bp, Artificial
  MsCOMT deletion introduced by TALEN pair MsCOMT_T02.1
tctctcaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10162 - DNA, 363 bp, Artificial
  MsCOMT deletion introduced by TALEN pair MsCOMT_T02.1
tctcgcaaaaacctcatcaatcacaaccatgggttcagcaggtgaaactcaaataacaccaacccacatatcagatgaagaagcaaacctcttcgccatgcaattagcaagtgcttcagttcttcccatgattttaaaatcagctcttgaacttgatctcttagaaatctctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10163 - DNA, 358 bp, Artificial
  MsCOMT deletion introduced by TALEN pair MsCOMT_T02.1
tctcgcaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10164 - DNA, 360 bp, Artificial
  MsCOMT deletion introduced by TALEN pair MsCOMT_T02.1
tctcccccccccctcctccctcacaaccatgggttcaacaggtgaaactcaaataacaccgacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10165 - DNA, 302 bp, Artificial
  MsCOMT deletion introduced by TALEN pair MsCOMT_T02.1
tctcccccccccctcctccctcacaaccatgggttcaacaggtgaaactcaaataacaccaacccacatatcagatgaagaagcaaacctcttcgccatgcaattagcaagtgcttcagttcttcccatcaaatttcacctattgaaatttcttctcagctcccaacaactaaccctgatgcaccagttatgttggaccgaatgttgcgtctcttggcttgttacaatatcctcacttgttcagttcgtactcaacaagatggaaaggtttagagactttatggtttggctactgttgctaa

SEQ ID NO: 10166 - DNA, 360 bp, Artificial
  MsCOMT deletion introduced by TALEN pair MsCOMT_T02.1
tctcccccccccctcctccctcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactaaagctggacctggtgctcaactttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10167 - DNA, 362 bp, Artificial
  MsCOMT deletion introduced by TALEN pair MsCOMT_T02.1
tctcccccccccctcctccatcacaaccattttttcaacatcttaaactcaaataacaccaacccacatatcagatgaagaagcaaacctcttctccattcaattatcaatttcttcatttcttcccatgattttaaaatcagctcttgaacttgatctcttagaaatcataaagctggacctggttctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10168 - DNA, 357 bp, Artificial
  MsCOMT deletion introduced by TALEN pair MsCOMT_T02.1
tctcccccccccctcatccctcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattgctggacctggtgctcaaatttcccctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10169 - DNA, 362 bp, Artificial
  MsCOMT deletion introduced by TALEN pair MsCOMT_T02.1
tctcccccccccctcatccctcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctaaagctggacctggtgctccaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10170 - DNA, 357 bp, Artificial
  MsCOMT deletion introduced by TALEN pair MsCOMT_T02.1
tctcccccccccctcatccctcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcccctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10171 - DNA, 354 bp, Artificial
  MsCOMT deletion introduced by TALEN pair MsCOMT_T02.1
tctcccccccccctcatccctcacaaccatgggttcaacaggtgaaactcaaataacaccaacccacatatcagatgaagaagcaaacctcttcgccatgaaattagcaagtgcttcagttcttcccatgattttaaaatcagctcttgaacttgatctcttagaagctggacctggtgctcaaatttcccctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 10172 - DNA, 358 bp, Artificial
  MsCOMT deletion introduced by TALEN pair MsCOMT_T02.1
tctcccccccccctcatccctcacaaccatgggttcaacaggtgaaactcaaataacaccaacccacatatcagatgaagaagcaaacctcttcgccatgaaattagcaagtgcttcagttcttcccatgattttaaaatcagctcttgaacttgatctcttagaaataagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 10173 - DNA, 358 bp, Artificial
  MsCOMT deletion introduced by TALEN pair MsCOMT_T02.1
tctcccccccccctcatcaatcacaaccattttttcaacatttgaaactcaaataacaccaacccacatatcagatgaagaagcaaacctcttcgccatgcaattagcaagttcttcagttcttcccatgattttaaaatcagctcttgaacttgatctcttagaatcatgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10174 - DNA, 366 bp, Artificial
  MsCOMT deletion introduced by TALEN pair MsCOMT_T02.1
tctccccccaccctcatcaatcacaaccatgggttcaacaggtgaaactcaaataacaccaacccacatatcagatgaagaagcaaacctcttcgccctgcccttcgcccgtgcttccgttcttcccatgattttgcactcagctcttgaacttgctctcttcgccctccttgctacagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10175 - DNA, 357 bp, Artificial
  MsCOMT deletion introduced by TALEN pair MsCOMT_T02.1
tctccccccaccctcatcaatcacaaccatgggttcaacaggtgaaactcaaataacaccaacccacatatcagatgaagaagcaaacctcttcgccctgcccttcgcccgtgcttccgttcttcccatgattttcccctcagctcttgaacttgctctcttcgcccccgctggacctggtgctccaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10176 - DNA, 348 bp, Artificial
  MsCOMT deletion introduced by TALEN pair MsCOMT_T02.1
tctccccccaccctcatcaatcacaaccatgggttcaacaggtgaaactcaaataacaccaacccacatatcagatgaagaagcaaacctcttcgccctgcccttcgcccgtgcttccgttcttcccatgattttccaatcagctcttgaacttgatccagctggacctggtgctcaaatttcacctattgacattgcttctcagctcccaacaactacccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10177 - DNA, 366 bp, Artificial
  MsCOMT deletion introduced by TALEN pair MsCOMT_T02.1
tctccccccaccctcatcaatcacaaccatgggttcaacaggtgaaactcaaataacaccaacccacatatcagatgaagaagcaaacctcttcgccctgcccttcgcccgtgcttccgttcttcccatgattttcacctcagctcttgaccttgctctcttagccctccttgctaccgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10178 - DNA, 366 bp, Artificial
  MsCOMT deletion introduced by TALEN pair MsCOMT_T02.1
tctccccccaccctcatcaatcacaaccatgggttcaacaggtgaaactcaaataacaccaacccacatatcagatgaagaagcaaacctcttcgccctgcccttcgcccgtgcttccgttcttcccatgattttaacatcagctcttgaacttgctctcttcgccctccttgctacagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10179 - DNA, 358 bp, Artificial
  MsCOMT deletion introduced by TALEN pair MsCOMT_T02.1
tctccccccaccctcatcaatcacaaccatgggttcaacaggtgaaactcaaataacaccaacccacatatcagatgaagaagcaaacctcttcgccctgcccctcgcccttgcttccgttcttcccatgattttgcactcagctcttgaccttgctctcttcgccctcatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10180 - DNA, 366 bp, Artificial
  MsCOMT deletion introduced by TALEN pair MsCOMT_T02.1
tctccccccaccctcatcaatcacaaccatgggttcaacaggtgaaactcaaataacaccaacccacatatcagatgaagaagcaaacctcttcgccctgcccctcgcccgtgcttccgttcttcccatgattttgcactcagctcttgaacttgctctcttagccctccttgctaacgctggaccttgtgctcaaatttcacctattgaaattgcttctcagctaccaacaactaaccctgatgcaccagttatgttggaccgaatgttgcgtctcttggcttgttacaatatcctcacttgttccgttcgtcctcaacaagatggaaaggttcagagactttatcgtttggctactgttgctaa

SEQ ID NO: 10181 - DNA, 366 bp, Artificial
  MsCOMT deletion introduced by TALEN pair MsCOMT_T02.1
tctccccccaccctcatcaatcacaaccatgggttcaacaggtgaaactcaaataacaccaacccacatatcagatgaagaagcaaacctcttcgccctgcccctcgcccgtgcttccgttcttcccatgattttgcaatcagctcttgaccttgatctcttcgccctccttgctacagctggacctggtgctcaaatttcacctattgaaattgcttctcagcttccaacaactacccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10182 - DNA, 366 bp, Artificial
  MsCOMT deletion introduced by TALEN pair MsCOMT_T02.1
tctccccccaccctcatcaatcacaaccatgggttcaacaggtgaaactcaaataacaccaacccacatatcagatgaagaagcaaacctcttcgccctgcccctcgcccgtgcttccgttcttcccatgattttcccctcagctcttgaacttgctctcttagccctccttgctaccgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10183 - DNA, 350 bp, Artificial
  MsCOMT deletion introduced by TALEN pair MsCOMT_T02.1
tctccccccaccctcatcaatcacaaccatgggttcaacaggtgaaactcaaataacaccaacccacatatcagatgaagaagcaaacctcttcgccctgcccctcgcccgtgcttccgttcttcccatgattttccaatcagctcttgcccttgctctcccgctggacctggtgctcccatttcacctcttgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 10184 - DNA, 366 bp, Artificial
  MsCOMT deletion introduced by TALEN pair MsCOMT_T02.1
tctccccccaccctcatcaatcacaaccatgggttcaacaggtgaaactcaaataacaccaacccacatatcagatgaagaagcaaacctcttcgccccgcccctcgcccgtgcttccgttcttcccatgattttgacctcagctcttgcacttgctctcttcgccctccttgctaccgctggaccttgtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10185 - DNA, 361 bp, Artificial
  MsCOMT deletion introduced by TALEN pair MsCOMT_T02.1
tctccccccaccctcatcaatcacaaccatgggttcaacaggggaaactcaaataacaccaacccacatatcagatgaagaagcaaacctcttcgccctgcccctcgcccgtgcttccgttcttcccatgattttgacctcagctcttgcccttgctctcttcgcaatccaaagctggacctggttctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10186 - DNA, 351 bp, Artificial
  MsCOMT deletion introduced by TALEN pair MsCOMT_T02.1
tctccccccaacctcatcaatcacaaccattgtttcaacaggtgaaactcaaataacaccaacccacatatcagatgaagaagcaaacctcttcgccatgcaactatcaagtacttcagttcttcccatgattttgaaatcagctcttgaacttgatctcttagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10187 - DNA, 361 bp, Artificial
  MsCOMT deletion introduced by TALEN pair MsCOMT_T02.1
tctcccccaccctcctcactcacaaccatgggttcaacaggtgaaactcaaataacaccaacccacatatcagatgaagaagcaaacctcgtcgccatgcaattagcacgtgcttcagttattcccatgattttaaaatcatctcttgaacttgatctcttagaaatcataaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagcctttatggtttggctactgttgctaa

SEQ ID NO: 10188 - DNA, 356 bp, Artificial
  MsCOMT deletion introduced by TALEN pair MsCOMT_T02.1
tctcccccacccctcctccatcacaaccatgggttcaacaggtgaaactcaaataacaccaacccacatatcagatgaagaagcaaacctcttcgccatgcaattagcccgtgcttcagttcttcccatgattttaaaatcagctcttgaacttgatctcttagaaaagctggacctggtgctcaaatttcccctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10189 - DNA, 359 bp, Artificial
  MsCOMT deletion introduced by TALEN pair MsCOMT_T02.1
tctcccccacccctcctccatcacaaccatgggttcaacaggtgaaactcaaataacaccaacccacatataagatgaagaagcaaacctcttcgccatgcaattagcccgtgcttcagttcttcccatgattttaaaatcagctcttgaacttgatctcttagaactaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 10190 - DNA, 360 bp, Artificial
  MsCOMT deletion introduced by TALEN pair MsCOMT_T02.1
tctcccccacccctcctccatcacaaccatgggttcaacaggtgaaactcaaataacaccaacccacatataagatgaagaagcaaacctcttcgccatgcaattagcccgtgcttcagttcttccaatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10191 - DNA, 361 bp, Artificial
  MsCOMT deletion introduced by TALEN pair MsCOMT_T02.1
tctcccccacccctcctccatcacaaccatgggttcaacaggtgaaactcaaataacaccaacccacatataagatgaagaagcaaacctcttcgccatgcaattagcccgtgctacagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 10192 - DNA, 359 bp, Artificial
  MsCOMT deletion introduced by TALEN pair MsCOMT_T02.1
tctcccccacccctcctccatcacaaccatgggttcaacaggtgaaactcaaataacaccaacccacatataagaggaagaagcaaacctcttcgccatgcaattagcccgtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 10193 - DNA, 361 bp, Artificial
  MsCOMT deletion introduced by TALEN pair MsCOMT_T02.1
tctcccccacccctcctccatcacaaccatgggttcaacaggtgaaactaaaataacaccaacccacatataagatgaagaagcaaacctcttcgccatgcaactagcccgtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10194 - DNA, 358 bp, Artificial
  MsCOMT deletion introduced by TALEN pair MsCOMT_T02.1
tctcccccacccctcctccatcacaaccatgggttcaacaggtgaaactaaaataacaccaacccacatataagaggaagaagcaaacctcttcgccatgcaactagcccgtgcttcagttcttccaatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 10195 - DNA, 355 bp, Artificial
  MsCOMT deletion introduced by TALEN pair MsCOMT_T02.1
tctcccccacccctcatcactcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcccctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10196 - DNA, 360 bp, Artificial
  MsCOMT deletion introduced by TALEN pair MsCOMT_T02.1
tctcccccacccctcatcactcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10197 - DNA, 356 bp, Artificial
  MsCOMT deletion introduced by TALEN pair MsCOMT_T02.1
tctcccccacccctcatcactcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10198 - DNA, 361 bp, Artificial
  MsCOMT deletion introduced by TALEN pair MsCOMT_T02.1
tctcccccacccctcatcactcacaaacatgggttcaacaggtgaaactcaaataacaccaacccacatatcagatgaagaagcaaacctcttcgccatgcaactagcaagtgcttcagttcttcccatgattttgaaatcggctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10199 - DNA, 361 bp, Artificial
  MsCOMT deletion introduced by TALEN pair MsCOMT_T02.1
tctcccccacccctcatcactcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10200 - DNA, 320 bp, Artificial
  MsCOMT deletion introduced by TALEN pair MsCOMT_T02.1
tctcccccaaacctcatcaatcacaaccatggtttcaacaggtgaaactcaaataacaccaacccacatatcagatgaagaagcaaacctcttcgccatgcaattagcaagtgcttcagttcttcccatgattttaaaatcagctcttgaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 10201 - DNA, 359 bp, Artificial
  MsCOMT deletion introduced by TALEN pair MsCOMT_T02.1
tctcccaaaaacctcatcaatcacaaccgtgggttcaacaggtgaaactcaaataacaccaacccacatatcagatgaagaatcaaacctcttcgccatgcaattagcaagtgcttcagttcttcccatgattttaaaatcagctcttgaacttgatctcttagaaataaagctgtacctggtgctcaaagttcacctattgaaattgcttctcagctcccaacaactaaccctgatgcaccagttatgttggaccgagtgttgcgtctcttggcttgttagaatatgctcacttgttcagttcgtactcaacaagatggaaaggttcagagaatttatggtttggctactgttgctaa

SEQ ID NO: 10202 - DNA, 360 bp, Artificial
  MsCOMT deletion introduced by TALEN pair MsCOMT_T02.1
tctccacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcggttcgtactcaacaagatggaaaggttcagagactttatggtttggctactgttgctaa

SEQ ID NO: 10203 - DNA, 356 bp, Artificial
  MsCOMT deletion introduced by TALEN pair MsCOMT_T02.1
tctccaaaacctcatcaatcacaaccatgggttcaacaggtgaaactcaaataacaccaacccacatatcagatgaagaagccaacctcttcgccatgcaattagcaagtgcttcagttcttcccatgattttaaaatcagctcttgaacttgatctcttagaaatcagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10204 - DNA, 358 bp, Artificial
  MsCOMT deletion introduced by TALEN pair MsCOMT_T02.1
tctccaaaacctcatcaatcacaaccatgggttcaacaggtgaaactcaaataacaccaacccacatatcagatgaagaagccaacctcttcgccatgcaattagcaagtgcttcagttcttcccatgattttaaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10205 - DNA, 355 bp, Artificial
  MsCOMT deletion introduced by TALEN pair MsCOMT_T02.1
tctccaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10206 - DNA, 352 bp, Artificial
  MsCOMT deletion introduced by TALEN pair MsCOMT_T02.1
tctccaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10207 - DNA, 357 bp, Artificial
  MsCOMT deletion introduced by TALEN pair MsCOMT_T02.1
tctccaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10208 - DNA, 310 bp, Artificial
  MsCOMT deletion introduced by TALEN pair MsCOMT_T02.1
tctccaaaacctcatcaatcacaaccatgggttcaacaggtgaaactcaaataacaccaacccacatatcagatgaagaagcaaacctcttcgccatgcaactagcaagtgcttcagttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10209 - DNA, 357 bp, Artificial
  MsCOMT deletion introduced by TALEN pair MsCOMT_T02.1
tctccaaaaacctctcaatcacaaccatgggttcaacaggtgaaactcaaataacaccaacccacatatcagatgaagaagcaaacctcttcgccatgcaattagcaagtgcttcagttcttcccatgattttaaaatcagttcttgaacttgatctcttagaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10210 - DNA, 358 bp, Artificial
  MsCOMT deletion introduced by TALEN pair MsCOMT_T02.1
tctccaaaaacctctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcgcctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttgggctactgttgctaa

SEQ ID NO: 10211 - DNA, 353 bp, Artificial
  MsCOMT deletion introduced by TALEN pair MsCOMT_T02.1
tctccaaaaacctcctcaatcacaaccattggttcaacaggtgaaactcaaataacaccaacccacatatcagatgaagaagcaaacctcttcgccatgcaattagcaagtgcttcagttcttcccatgattttaaaatcagctcttgaacttgatctcttctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 10212 - DNA, 360 bp, Artificial
  MsCOMT deletion introduced by TALEN pair MsCOMT_T02.1
tctccaaaaacctcctcaatcacaaccatgggttcaacaggtgaaactcaaataacaccaacccacatatcagatgaagaagcaaacctcttcgccattcaactagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10213 - DNA, 360 bp, Artificial
  MsCOMT deletion introduced by TALEN pair MsCOMT_T02.1
tctccaaaaacctcctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggatactgttgctaa

SEQ ID NO: 10214 - DNA, 356 bp, Artificial
  MsCOMT deletion introduced by TALEN pair MsCOMT_T02.1
tctccaaaaacctcctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10215 - DNA, 357 bp, Artificial
  MsCOMT deletion introduced by TALEN pair MsCOMT_T02.1
tctccaaaaacctcatcaatcacaaccattggttcaacaggtgaaactcaaataacaccaacccacatatcagatgaagaagcaaacctcttcgccattcaactagcaagtgcttcagttcttcccatgattttgaaatcatctcttgaacttgatctcttagaaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10216 - DNA, 474 bp, Artificial
  MsCOMT deletion introduced by TALEN pair MsCOMT_T02.1
tctccaaaaacctcatcaatcacaaccattggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagccgctggaccgtctccagcgcctgcttgccaccgccattgctggcgatggccaccacctgctggggggtcaagccgtgggcctggcacagcaccggcaacaggcgctggagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10217 - DNA, 359 bp, Artificial
  MsCOMT deletion introduced by TALEN pair MsCOMT_T02.1
tctccaaaaacctcatcaatcacaaccatggttcaacaggtgcaactcaaataacaccaacccacatatcagatgaagaagccaacctcttcgccatgcaactagcaagagcttcagttcttcccatgattttgaaatcagctcttgaacttgatctcttataaatctaaagctggacctggtgctcaaatttcacctattgaaattgcttctcagctaccaacaactaaccctgatgcaccagttatgttggaccgaatgttgcgtctcttggcttgttacaataccctcacttgttcagttcgtactcaacaagatggaaaggttcagagactttatggtttggctactgttgctaa

SEQ ID NO: 10218 - DNA, 356 bp, Artificial
  MsCOMT deletion introduced by TALEN pair MsCOMT_T02.1
tctccaaaaacctcatcaatcacaaccatgggttcaacaggtgaaactccaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10219 - DNA, 352 bp, Artificial
  MsCOMT deletion introduced by TALEN pair MsCOMT_T02.1
tctccaaaaacctcatcaatcacaaccatgggttcaacaggtgaaactccaataacaccaacccacatatcagatgaagaagcaaacctcttcgccatgcaactagcaagtgcttcagttcttcccatgattttgaaatcagctcttgaacttgatctcttagagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10220 - DNA, 356 bp, Artificial
  MsCOMT deletion introduced by TALEN pair MsCOMT_T02.1
tctccaaaaacctcatcaatcacaaccatgggttcaacaggtgaaactccaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10221 - DNA, 360 bp, Artificial
  MsCOMT deletion introduced by TALEN pair MsCOMT_T02.1
tctccaaaaacctcatcaatcacaaccatgggttcaacaggtgaaactcaaatcacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10222 - DNA, 360 bp, Artificial
  MsCOMT deletion introduced by TALEN pair MsCOMT_T02.1
tctccaaaaacctcatcaatcacaaccatgggttcaacaggtgaaactcaaatcacaccaacccacatatcagatgaagaagcaaacctcttcgccatgcaactagcaagtgcttcagttcttcccatgattttgaaatcagctcttgaacttgatctcttagaaatcataagctggacctggtgctcaaatttcacctattgaaattgcttctcagctcccaacaactaaccctgatgcaccagttatgttggaccgaatgtggcgtctcttggcttgttacaatatcctcacttgttcagttcgtactcaacaagatggaaaggttcagagactttatggtttggctactgttgctaa

SEQ ID NO: 10223 - DNA, 361 bp, Artificial
  MsCOMT deletion introduced by TALEN pair MsCOMT_T02.1
tctccaaaaacctcatcaatcacaaccatgggttcaacaggtgaaactcaaatcacaccaacccacatatcagatgaagaagcaaacctcttcgccatgcaactagcaagtgcttcagttcttcccatgattttgaaatcagctcttgaacttgatctcttagaaatcataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10224 - DNA, 359 bp, Artificial
  MsCOMT deletion introduced by TALEN pair MsCOMT_T02.1
tctccaaaaacctcatcaatcacaaccatgggttcaacaggtgaaactcaaatcacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10225 - DNA, 355 bp, Artificial
  MsCOMT deletion introduced by TALEN pair MsCOMT_T02.1
tctccaaaaacctcatcaatcacaaccatgggttcaacaggtgaaactcaaatcacaccaacccacatatcagatgaagaagcaaacctcttcgccatgcaactagcaagtgcttcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10226 - DNA, 358 bp, Artificial
  MsCOMT deletion introduced by TALEN pair MsCOMT_T02.1
tctccaaaaacctcatcaatcacaaccatgggttcaacaggtgaaactcaaataacgccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10227 - DNA, 361 bp, Artificial
  MsCOMT deletion introduced by TALEN pair MsCOMT_T02.1
tctccaaaaacctcatcaatcacaaccatgggttcaacaggtgaaactcaaataacaccaacccacatatcagatgaagaagcaaacctcttcgccattcaattagcaagtgcttcagttcttcccatgattttaaaatcagctcttgaacttgatctcttagaaatcctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10228 - DNA, 360 bp, Artificial
  MsCOMT deletion introduced by TALEN pair MsCOMT_T02.1
tctccaaaaacctcatcaatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttagaaatcaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10229 - DNA, 355 bp, Artificial
  MsCOMT deletion introduced by TALEN pair MsCOMT_T02.1
tctccaaaaacctcatcaatcacaaccatgggttcaacaggtgaaactcaaataacaccaacccacatatcagatgaagaagcaaacctcttcgccattcaactagcaagtgcttcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10230 - DNA, 360 bp, Artificial
  MsCOMT deletion introduced by TALEN pair MsCOMT_T02.1
tctccaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 10231 - DNA, 360 bp, Artificial
  MsCOMT deletion introduced by TALEN pair MsCOMT_T02.1
tctccaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10232 - DNA, 359 bp, Artificial
  MsCOMT deletion introduced by TALEN pair MsCOMT_T02.1
tctccaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10233 - DNA, 359 bp, Artificial
  MsCOMT deletion introduced by TALEN pair MsCOMT_T02.1
tctccaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10234 - DNA, 355 bp, Artificial
  MsCOMT deletion introduced by TALEN pair MsCOMT_T02.1
tctccaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10235 - DNA, 349 bp, Artificial
  MsCOMT deletion introduced by TALEN pair MsCOMT_T02.1
tctccaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10236 - DNA, 344 bp, Artificial
  MsCOMT deletion introduced by TALEN pair MsCOMT_T02.1
tctccaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10237 - DNA, 353 bp, Artificial
  MsCOMT deletion introduced by TALEN pair MsCOMT_T02.1
tctccaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10238 - DNA, 359 bp, Artificial
  MsCOMT deletion introduced by TALEN pair MsCOMT_T02.1
tctccaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacatctaaccctgatgcaccagttatgttggaccgaatgtggcatctctgggcttgtgacaatatcctcgcttgttcagttcgtactcaacaagatggaaagattcagggactttatggtttggctactgttgctaa

SEQ ID NO: 10239 - DNA, 359 bp, Artificial
  MsCOMT deletion introduced by TALEN pair MsCOMT_T02.1
tctccaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcctgttacaatatcctcacttgttcagttcgtactcaacaagatggaaagattcagagactttatggtttggctactgttgctaa

SEQ ID NO: 10240 - DNA, 359 bp, Artificial
  MsCOMT deletion introduced by TALEN pair MsCOMT_T02.1
tctccaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgctcagttcgtactcaacaagatggaaaggttcagagactttatggtttggctactgttgctaa

SEQ ID NO: 10241 - DNA, 359 bp, Artificial
  MsCOMT deletion introduced by TALEN pair MsCOMT_T02.1
tctccaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10242 - DNA, 360 bp, Artificial
  MsCOMT deletion introduced by TALEN pair MsCOMT_T02.1
tctccaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10243 - DNA, 359 bp, Artificial
  MsCOMT deletion introduced by TALEN pair MsCOMT_T02.1
tctccaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttctaa

SEQ ID NO: 10244 - DNA, 359 bp, Artificial
  MsCOMT deletion introduced by TALEN pair MsCOMT_T02.1
tctccaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 10245 - DNA, 358 bp, Artificial
  MsCOMT deletion introduced by TALEN pair MsCOMT_T02.1
tctccaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgatgctaa

SEQ ID NO: 10246 - DNA, 354 bp, Artificial
  MsCOMT deletion introduced by TALEN pair MsCOMT_T02.1
tctccaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 10247 - DNA, 354 bp, Artificial
  MsCOMT deletion introduced by TALEN pair MsCOMT_T02.1
tctccaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctgatgctcaaatttcacctattgaaattgcttctcagctcccaacaactaaccctgatgcaccagttatgttggaccgaatgttgcgtctcttggcttgatacaatatcctcacttgttcagttcgtactcaacaagatggaaaggttcagagactttatggtttggctactgttgctaa

SEQ ID NO: 10248 - DNA, 355 bp, Artificial
  MsCOMT deletion introduced by TALEN pair MsCOMT_T02.1
tctccaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10249 - DNA, 357 bp, Artificial
  MsCOMT deletion introduced by TALEN pair MsCOMT_T02.1
tctccaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10250 - DNA, 344 bp, Artificial
  MsCOMT deletion introduced by TALEN pair MsCOMT_T02.1
tctccaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatcctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10251 - DNA, 347 bp, Artificial
  MsCOMT deletion introduced by TALEN pair MsCOMT_T02.1
tctccaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactggtgctaa

SEQ ID NO: 10252 - DNA, 286 bp, Artificial
  MsCOMT deletion introduced by TALEN pair MsCOMT_T02.1
tctccaaaaacctcatcaatcacaaccatgggttcaacaggtgaaactcaaataacaccaacccacatatcagatgaagaagcaaacctcttcgccatgcaattagcaagtgcttcagttcttcccatgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10253 - DNA, 352 bp, Artificial
  MsCOMT deletion introduced by TALEN pair MsCOMT_T02.1
tctccaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatttcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10254 - DNA, 353 bp, Artificial
  MsCOMT deletion introduced by TALEN pair MsCOMT_T02.1
tctccaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatcttgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10255 - DNA, 350 bp, Artificial
  MsCOMT deletion introduced by TALEN pair MsCOMT_T02.1
tctccaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10256 - DNA, 342 bp, Artificial
  MsCOMT deletion introduced by TALEN pair MsCOMT_T02.1
tctccaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10257 - DNA, 353 bp, Artificial
  MsCOMT deletion introduced by TALEN pair MsCOMT_T02.1
tctccaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10258 - DNA, 360 bp, Artificial
  MsCOMT deletion introduced by TALEN pair MsCOMT_T02.1
tctccaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattgctaaatggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10259 - DNA, 359 bp, Artificial
  MsCOMT deletion introduced by TALEN pair MsCOMT_T02.1
tctccaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10260 - DNA, 359 bp, Artificial
  MsCOMT deletion introduced by TALEN pair MsCOMT_T02.1
tctccaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10261 - DNA, 360 bp, Artificial
  MsCOMT deletion introduced by TALEN pair MsCOMT_T02.1
tctccaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10262 - DNA, 360 bp, Artificial
  MsCOMT deletion introduced by TALEN pair MsCOMT_T02.1
tctccaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10263 - DNA, 356 bp, Artificial
  MsCOMT deletion introduced by TALEN pair MsCOMT_T02.1
tctccaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10264 - DNA, 362 bp, Artificial
  MsCOMT deletion introduced by TALEN pair MsCOMT_T02.1
tctccaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10265 - DNA, 423 bp, Artificial
  MsCOMT deletion introduced by TALEN pair MsCOMT_T02.1
tctccaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagcaggtgttggccatcgccagcaatattggtgccaagcaggcgctggagacggtgcaggcgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10266 - DNA, 358 bp, Artificial
  MsCOMT deletion introduced by TALEN pair MsCOMT_T02.1
tctccaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10267 - DNA, 358 bp, Artificial
  MsCOMT deletion introduced by TALEN pair MsCOMT_T02.1
tctccaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10268 - DNA, 358 bp, Artificial
  MsCOMT deletion introduced by TALEN pair MsCOMT_T02.1
tctccaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10269 - DNA, 354 bp, Artificial
  MsCOMT deletion introduced by TALEN pair MsCOMT_T02.1
tctccaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 10270 - DNA, 354 bp, Artificial
  MsCOMT deletion introduced by TALEN pair MsCOMT_T02.1
tctccaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10271 - DNA, 354 bp, Artificial
  MsCOMT deletion introduced by TALEN pair MsCOMT_T02.1
tctccaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagcctttatggtttggctactgttgctaa

SEQ ID NO: 10272 - DNA, 359 bp, Artificial
  MsCOMT deletion introduced by TALEN pair MsCOMT_T02.1
tctccaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 10273 - DNA, 348 bp, Artificial
  MsCOMT deletion introduced by TALEN pair MsCOMT_T02.1
tctccaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10274 - DNA, 355 bp, Artificial
  MsCOMT deletion introduced by TALEN pair MsCOMT_T02.1
tctccaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10275 - DNA, 355 bp, Artificial
  MsCOMT deletion introduced by TALEN pair MsCOMT_T02.1
tctccaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10276 - DNA, 355 bp, Artificial
  MsCOMT deletion introduced by TALEN pair MsCOMT_T02.1
tctccaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10277 - DNA, 351 bp, Artificial
  MsCOMT deletion introduced by TALEN pair MsCOMT_T02.1
tctccaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaagctggacctggtgctcaaatttcacctattgaaattgcttctcagctaccaacaactaaccctgatgcaccagttatgttggatcgaatgttgcgtctcttggcttgttacaatatcctcacttgttcagttcgtactcaacaagatggaaagattcagagactttatggtttggctactgttgctaa

SEQ ID NO: 10278 - DNA, 352 bp, Artificial
  MsCOMT deletion introduced by TALEN pair MsCOMT_T02.1
tctccaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10279 - DNA, 359 bp, Artificial
  MsCOMT deletion introduced by TALEN pair MsCOMT_T02.1
tctccaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 10280 - DNA, 352 bp, Artificial
  MsCOMT deletion introduced by TALEN pair MsCOMT_T02.1
tctccaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10281 - DNA, 347 bp, Artificial
  MsCOMT deletion introduced by TALEN pair MsCOMT_T02.1
tctccaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10282 - DNA, 349 bp, Artificial
  MsCOMT deletion introduced by TALEN pair MsCOMT_T02.1
tctccaaaaacctcatcaatcacaacaatgggttcaacaggtgaaactcaaataacaccaacccacatatcagataaagaagcaaacctcttcgccatgcaactagcaagtgcttcagttcttcccatgattttgaaatcagctcttgaacttgatctcttagactacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10283 - DNA, 349 bp, Artificial
  MsCOMT deletion introduced by TALEN pair MsCOMT_T02.1
tctccaaaaacctcatcaatcacaacaatgggttcaacaggtgaaactcaaataaaaccaacccacatatcagatgaagaagcaaacctcttcgccatgcaactagcaagtgcttcagttcttcccatgattttgaaatcagctcttgaacttgatctcttagactacctggtgctcaaatttcacctattgaaattgcttctcagctaccaacaactaaccctgatgcaccagttatgttggaccgaatgtttcgtctcttggcttgttacaattacctcacttattcagttcgtactcaaccagatggaaaggttcagagactttatggtttggcgactgttactaa

SEQ ID NO: 10284 - DNA, 359 bp, Artificial
  MsCOMT deletion introduced by TALEN pair MsCOMT_T02.1
tctccaaaaacctcacaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 10285 - DNA, 341 bp, Artificial
  MsCOMT deletion introduced by TALEN pair MsCOMT_T02.1
tctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctgctgttgctaa

SEQ ID NO: 10286 - DNA, 349 bp, Artificial
  MsCOMT deletion introduced by TALEN pair MsCOMT_T02.1
tctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10287 - DNA, 358 bp, Artificial
  MsCOMT deletion introduced by TALEN pair MsCOMT_T02.1
tctcataaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10288 - DNA, 360 bp, Artificial
  MsCOMT deletion introduced by TALEN pair MsCOMT_T02.1
tctcataaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10289 - DNA, 355 bp, Artificial
  MsCOMT deletion introduced by TALEN pair MsCOMT_T02.1
tctcataaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctgttgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 10290 - DNA, 353 bp, Artificial
  MsCOMT deletion introduced by TALEN pair MsCOMT_T02.1
tctcataaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaactttcccctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10291 - DNA, 348 bp, Artificial
  MsCOMT deletion introduced by TALEN pair MsCOMT_T02.1
tctcataaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10292 - DNA, 359 bp, Artificial
  MsCOMT deletion introduced by TALEN pair MsCOMT_T02.1
tctcataaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10293 - DNA, 374 bp, Artificial
  MsCOMT deletion introduced by TALEN pair MsCOMT_T02.1
tctcagacagtctcacaaaaacctcatcaatcacaaccatgggttcaacaggtgaaactcaaataacaccaacccacatatccgatgaagaagcaaacctcttcgccatgcaattagcaagtgcttcagttcttcccatgattttaaaatcagctcttgaacttgatctcttagaaatcagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10294 - DNA, 357 bp, Artificial
  MsCOMT deletion introduced by TALEN pair MsCOMT_T02.1
tctcacgaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10295 - DNA, 360 bp, Artificial
  MsCOMT deletion introduced by TALEN pair MsCOMT_T02.1
tctcacgaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10296 - DNA, 332 bp, Artificial
  MsCOMT deletion introduced by TALEN pair MsCOMT_T02.1
tctcacgaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10297 - DNA, 362 bp, Artificial
  MsCOMT deletion introduced by TALEN pair MsCOMT_T02.1
tctcacgaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10298 - DNA, 359 bp, Artificial
  MsCOMT deletion introduced by TALEN pair MsCOMT_T02.1
tctcacgaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10299 - DNA, 362 bp, Artificial
  MsCOMT deletion introduced by TALEN pair MsCOMT_T02.1
tctcacgaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10300 - DNA, 360 bp, Artificial
  MsCOMT deletion introduced by TALEN pair MsCOMT_T02.1
tctcacgaaaacctcatcaatcacaaccatgggttcaacaggtgaaactcaaataacaccaacccacatatcagatgaagaagcaaacctcttcgccatgcaactaacaagtgcttcagttcttccaatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10301 - DNA, 350 bp, Artificial
  MsCOMT deletion introduced by TALEN pair MsCOMT_T02.1
tctcacgaaaacctcatcaatcacaaccatgggttcaacaggggaaactcaaataacaccaacccacatatcagatgaagaagcaaatctcttcgccatgcaattagaaagtgcttcagttcttcccatgatttgaaaatcagctcttgaacttgatctcttagaactcattggtgctcaaatttcacctattgaaattgcttctcagctcccaacaactaaccctcatgcaccagttatgttggaccgaatgttgcgtctcttggcttgttacaatatcctcacttgttcagttcgtacacagcaagatggaaaggttaagagactttatggtttggtactgttgataa

SEQ ID NO: 10302 - DNA, 349 bp, Artificial
  MsCOMT deletion introduced by TALEN pair MsCOMT_T02.1
tctcaccctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgcta

SEQ ID NO: 10303 - DNA, 362 bp, Artificial
  MsCOMT deletion introduced by TALEN pair MsCOMT_T02.1
tctcaccaaaaacctcatcaatcacaaccatgggttcaacaggtgaaactcaactaacaccaacccacatatcagatgaagacgcaaacctcttcgccatgcaactagcaagtgcttcagttcttcccatgattttgaaatcagctcttgaacttgatctcttagaaatctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 10304 - DNA, 358 bp, Artificial
  MsCOMT deletion introduced by TALEN pair MsCOMT_T02.1
tctcaccaaaaacctcatcaatcacaaccatgggttcaacaggtgaaactcaaataacaccaacccacatatcagatgaagacgcaaacctcttcgccatgcaactagcaagtgcttcagttcttcccatgattttgaaatcagctcttgaacttgatctcttagaaatcattggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10305 - DNA, 427 bp, Artificial
  MsCOMT deletion introduced by TALEN pair MsCOMT_T02.1
tctcaccaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttgctggggggtcaagccgtgggcctggcacagcaccggcaacagccgctggaccgtctccagcgcctgcttgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10306 - DNA, 351 bp, Artificial
  MsCOMT deletion introduced by TALEN pair MsCOMT_T02.1
tctcacatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10307 - DNA, 352 bp, Artificial
  MsCOMT deletion introduced by TALEN pair MsCOMT_T02.1
tctcacatcaatcacaaccatgggttcaacaggtgaaactcaaataacaccaacccacatatcagatgaagaagcaaacctcttcgccatgcaactatcaagtgcttcagttcttcccatgattttaaaatcagctcttgaacttgatctcttagaaatcaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10308 - DNA, 359 bp, Artificial
  MsCOMT deletion introduced by TALEN pair MsCOMT_T02.1
tctcacataaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10309 - DNA, 354 bp, Artificial
  MsCOMT deletion introduced by TALEN pair MsCOMT_T02.1
tctcacagaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10310 - DNA, 360 bp, Artificial
  MsCOMT deletion introduced by TALEN pair MsCOMT_T02.1
tctcacagaaacctcatcaatcacaaccatgggttcaacaggtgaaactcaaataacaccagcccacatatcagatgaagaagcaaacctcttcgccatgcaactagcaagtgcttcagttcttcccatgattttgaaatcagctcttgaacttgatctcttagaagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10311 - DNA, 361 bp, Artificial
  MsCOMT deletion introduced by TALEN pair MsCOMT_T02.1
tctcacagaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaagttcagagcctttatggtttggctactgttgctaa

SEQ ID NO: 10312 - DNA, 353 bp, Artificial
  MsCOMT deletion introduced by TALEN pair MsCOMT_T02.1
tctcacagaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10313 - DNA, 359 bp, Artificial
  MsCOMT deletion introduced by TALEN pair MsCOMT_T02.1
tctcacagaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10314 - DNA, 353 bp, Artificial
  MsCOMT deletion introduced by TALEN pair MsCOMT_T02.1
tctcacagaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10315 - DNA, 359 bp, Artificial
  MsCOMT deletion introduced by TALEN pair MsCOMT_T02.1
tctcacagaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10316 - DNA, 352 bp, Artificial
  MsCOMT deletion introduced by TALEN pair MsCOMT_T02.1
tctcacagaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10317 - DNA, 356 bp, Artificial
  MsCOMT deletion introduced by TALEN pair MsCOMT_T02.1
tctcacactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10318 - DNA, 349 bp, Artificial
  MsCOMT deletion introduced by TALEN pair MsCOMT_T02.1
tctcacacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10319 - DNA, 358 bp, Artificial
  MsCOMT deletion introduced by TALEN pair MsCOMT_T02.1
tctcacacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcactaagctggacctggtgctcaaatttcacctattgaaattgcttctcagctcccaacaactaaccctgatgcaccagttatgttggaccgaatgttgcgtctcttggcttgttacaatatcctctcttgttcagttcgtacccaacaagatggaaaggttcagagactttatggtttggctactgttgctaa

SEQ ID NO: 10320 - DNA, 356 bp, Artificial
  MsCOMT deletion introduced by TALEN pair MsCOMT_T02.1
tctcacacaaacctcatcaatcacaaccctgggttcaacaggtgaaactcaaataacaccaacccacatatcagatgaagaagcaaacctcttcgccatgcaactagcaagcgcttcagttcttcccatgattttgaaatcagctcttgaacttgatctattagaaaagctgaacctggtgctcaaatttcacctattgaaattgcttcccagctcccaacaactaaccctgatgcaccaggtatgttggaccgaatgttgcggctcttggcttgttacaatatcctcacttgttcagtgcgtactcaacaagatggaaaggttccgaggctgtatggtttagctactggtgctaa

SEQ ID NO: 10321 - DNA, 359 bp, Artificial
  MsCOMT deletion introduced by TALEN pair MsCOMT_T02.1
tctcacacaaacctcatcaatcacaaccatggtttcaacaggtgaaactcaaataacaccaacccacatatcagatgaagaagcaaacctcttcgccatgcaactagcaagtgcttcagttcttcccatgattttgaaatcagctcttgaacttgatctcttagacataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10322 - DNA, 362 bp, Artificial
  MsCOMT deletion introduced by TALEN pair MsCOMT_T02.1
tctcacacaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatgttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10323 - DNA, 362 bp, Artificial
  MsCOMT deletion introduced by TALEN pair MsCOMT_T02.1
tctcacacaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10324 - DNA, 353 bp, Artificial
  MsCOMT deletion introduced by TALEN pair MsCOMT_T02.1
tctcacacaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10325 - DNA, 356 bp, Artificial
  MsCOMT deletion introduced by TALEN pair MsCOMT_T02.1
tctcacacaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10326 - DNA, 362 bp, Artificial
  MsCOMT deletion introduced by TALEN pair MsCOMT_T02.1
tctcacacaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactgtatggtttggctactgttgctaa

SEQ ID NO: 10327 - DNA, 363 bp, Artificial
  MsCOMT deletion introduced by TALEN pair MsCOMT_T02.1
tctcacacaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10328 - DNA, 360 bp, Artificial
  MsCOMT deletion introduced by TALEN pair MsCOMT_T02.1
tctcacacaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttatcagctcccaacaactaaccctgatgcaccagttatgttggaccgaatgttgcgtctcctggcttgttacaatatcctcacttgttcagttcgtactcaacaagatggaaagattcagagactttatggtttggctactgttgctaa

SEQ ID NO: 10329 - DNA, 360 bp, Artificial
  MsCOMT deletion introduced by TALEN pair MsCOMT_T02.1
tctcacacaaacctcatcaatcacaaccatgggttcaacaggtgaaactcaaataacaccaacccacatatcagatgaagaagcaaacctcttcgccatgcaattagcaagtgcttcagttcttcccatgattgtaaaatcagctcctgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10330 - DNA, 361 bp, Artificial
  MsCOMT deletion introduced by TALEN pair MsCOMT_T02.1
tctcacacaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgatcttgatctcttataaatctaaagctggaactggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttagggtttggctactgttgctaa

SEQ ID NO: 10331 - DNA, 360 bp, Artificial
  MsCOMT deletion introduced by TALEN pair MsCOMT_T02.1
tctcacacaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaacataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtctggctactgttgctaa

SEQ ID NO: 10332 - DNA, 355 bp, Artificial
  MsCOMT deletion introduced by TALEN pair MsCOMT_T02.1
tctcacacaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10333 - DNA, 359 bp, Artificial
  MsCOMT deletion introduced by TALEN pair MsCOMT_T02.1
tctcacacaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggatactgttgctaa

SEQ ID NO: 10334 - DNA, 360 bp, Artificial
  MsCOMT deletion introduced by TALEN pair MsCOMT_T02.1
tctcacacaaacctcatcaatcacaaccatgggttcaacaggtgaaactcaaataacaccaacccacatatcagatgaagaagcaaacctcttcgccatgcaactagcaagggcttcagttcttcccattattttgaaatcgtctcttgatcttgatctcttagaaatcaaagcagcatctgttgctcaaatttcacctattggaattgcttctcagctaccaacaactaaccctgatgcaccatttatgttggaccgaatgtttcgtctcttgtcttgttacaatatcctcacctgttcagttcggactcaacaagatggaaaagttcagagaatttatagtttggcgacggttgctca

SEQ ID NO: 10335 - DNA, 350 bp, Artificial
  MsCOMT deletion introduced by TALEN pair MsCOMT_T02.1
tctcacacaaacctcatcaatcacaaccatgggttcaacaggggaaactcaaataacaccaacccacatatcagatgaagaagcaaacctcttcgccatgcaattagcaagtgcttcagttcttcccatgattttgaaatcagctcttgaacttgatctcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10336 - DNA, 353 bp, Artificial
  MsCOMT deletion introduced by TALEN pair MsCOMT_T02.1
tctcacaatcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatgtttggctactgttgctaa

SEQ ID NO: 10337 - DNA, 355 bp, Artificial
  MsCOMT deletion introduced by TALEN pair MsCOMT_T02.1
tctcacaagaacctcatcaatcacaaccatgggttcaacaggtgaaactcaaataacaccaacccacatatcagatgaagaagcaaacctcttcgccatgcaattagcaagtgcttcagttcttcccatgattttaaaattagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10338 - DNA, 358 bp, Artificial
  MsCOMT deletion introduced by TALEN pair MsCOMT_T02.1
tctcacaagaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagctaccaacaactaaccctgatgcaccagttatgtcggaccgaatgttgcgtctcttggcttgttacaatatcctcacttgttcagttcgtactcaacaagatggaaaggttcagagactttatggtttggctactgttgctaa

SEQ ID NO: 10339 - DNA, 361 bp, Artificial
  MsCOMT deletion introduced by TALEN pair MsCOMT_T02.1
tctcacaagaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 10340 - DNA, 349 bp, Artificial
  MsCOMT deletion introduced by TALEN pair MsCOMT_T02.1
tctcacaacctcatcaatcacaaccatgggttcaacaggtgacactcaaataacaccaacccacatatcagatgaagaagcacacctcttcgccatgcaactagcaagtgcttcagttcttcccatgattttgaaatcagctcttgaacttgatctcttagaaattacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10341 - DNA, 314 bp, Artificial
  MsCOMT deletion introduced by TALEN pair MsCOMT_T02.1
tctcacaacctcatcaatcacaaccatgggttcaacaggtgaaactcaaataacaccaacccacatatcagatgaagaagcaaacctcttcgccatgcaactagcaagtgcttcagttcttttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10342 - DNA, 290 bp, Artificial
  MsCOMT deletion introduced by TALEN pair MsCOMT_T02.1
tctcacaacctcatcaatcacaaccatgggttcaacaggtgaaactcaaataacaccaacccacatatcagatgaagaagcaaacctcttcgccatgcaactagcaagtgcttcagttcttcccatgattttgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10343 - DNA, 351 bp, Artificial
  MsCOMT deletion introduced by TALEN pair MsCOMT_T02.1
tctcacaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10344 - DNA, 357 bp, Artificial
  MsCOMT deletion introduced by TALEN pair MsCOMT_T02.1
tctcacaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10345 - DNA, 357 bp, Artificial
  MsCOMT deletion introduced by TALEN pair MsCOMT_T02.1
tctcacaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10346 - DNA, 349 bp, Artificial
  MsCOMT deletion introduced by TALEN pair MsCOMT_T02.1
tctcacaacaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10347 - DNA, 352 bp, Artificial
  MsCOMT deletion introduced by TALEN pair MsCOMT_T02.1
tctcacaaatcatccatcacaaccatgggttcaacaggtgaacctcaaataacaccaacccacatatcagatgaagaagcaaacctcttcgccatgcaattagcaagtgcttcagttcttcccatgattttaaaatcagctcttgaacttgatctcttagaaatcctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10348 - DNA, 349 bp, Artificial
  MsCOMT deletion introduced by TALEN pair MsCOMT_T02.1
tctcacaaatcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10349 - DNA, 350 bp, Artificial
  MsCOMT deletion introduced by TALEN pair MsCOMT_T02.1
tctcacaaatcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10350 - DNA, 356 bp, Artificial
  MsCOMT deletion introduced by TALEN pair MsCOMT_T02.1
tctcacaaatcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10351 - DNA, 348 bp, Artificial
  MsCOMT deletion introduced by TALEN pair MsCOMT_T02.1
tctcacaaatacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10352 - DNA, 343 bp, Artificial
  MsCOMT deletion introduced by TALEN pair MsCOMT_T02.1
tctcacaaagacctcatcaatcacaaccatgggttcaacaggtgaaactcaaataacaccaacccacatatcagatgaagaagcaaacctcttcgccatgcaattagcatgtgcttcagttcttcccatgattttaaaatcagctcttgaacttagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagcctttatggtttggctactgttgctaa

SEQ ID NO: 10353 - DNA, 359 bp, Artificial
  MsCOMT deletion introduced by TALEN pair MsCOMT_T02.1
tctcacaaagacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10354 - DNA, 357 bp, Artificial
  MsCOMT deletion introduced by TALEN pair MsCOMT_T02.1
tctcacaaagacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10355 - DNA, 352 bp, Artificial
  MsCOMT deletion introduced by TALEN pair MsCOMT_T02.1
tctcacaaagacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10356 - DNA, 357 bp, Artificial
  MsCOMT deletion introduced by TALEN pair MsCOMT_T02.1
tctcacaaactcatcaatcacaaccatgggttcaacaggtgacactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctgttcaaattgcttctcagcttccaacatctaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 10357 - DNA, 350 bp, Artificial
  MsCOMT deletion introduced by TALEN pair MsCOMT_T02.1
tctcacaaacctctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcggagactttatggtttggctactgttgctaa

SEQ ID NO: 10358 - DNA, 357 bp, Artificial
  MsCOMT deletion introduced by TALEN pair MsCOMT_T02.1
tctcacaaacctctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10359 - DNA, 361 bp, Artificial
  MsCOMT deletion introduced by TALEN pair MsCOMT_T02.1
tctcacaaacctcatcaatcacaaccatgggttcaacaggtgaaactcgaataacaccaacccacatatcagatgaagaagcaaacctcttcgccatgcaattagcaagtgcttcagttcttcccatgattttaaaatcagctcttgaacttgatctcttagaaatcattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10360 - DNA, 358 bp, Artificial
  MsCOMT deletion introduced by TALEN pair MsCOMT_T02.1
tctcacaaacctcatcaatcacaaccatgggttcaacaggtgaaactcacataacaccaacccacatatcagatgaagaagcaaacctcttcgccattcaactagcaagtgcttcagttcttcccatgattttgaaatcagctcttgaacttgatctcttagaaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10361 - DNA, 345 bp, Artificial
  MsCOMT deletion introduced by TALEN pair MsCOMT_T02.1
tctcacaaacctcatcaatcacaaccatgggttcaacaggtgaaactcaaataacaccatcccacatatcagatgaagaagccaacctcttcgccatgcaattagcaagtgcttcagttcttcccatgattttaaaatcagctcttgaacttgatctcttagaaatggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10362 - DNA, 357 bp, Artificial
  MsCOMT deletion introduced by TALEN pair MsCOMT_T02.1
tctcacaaacctcatcaatcacaaccatgggttcaacaggtgaaactcaaataacaccaacccacatatcagatgaagaagccaacctcttcgccatgcaattagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10363 - DNA, 358 bp, Artificial
  MsCOMT deletion introduced by TALEN pair MsCOMT_T02.1
tctcacaaacctcatcaatcacaaccatgggttcaacaggtgaaactcaaataacaccaacccacatatcagatgaagaagccaacctcttcgccatgcaactagcaagtgcttcagttcttcccatgattttgaaatcagctcttgaacttgatctcttagaaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10364 - DNA, 359 bp, Artificial
  MsCOMT deletion introduced by TALEN pair MsCOMT_T02.1
tctcacaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10365 - DNA, 357 bp, Artificial
  MsCOMT deletion introduced by TALEN pair MsCOMT_T02.1
tctcacaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10366 - DNA, 358 bp, Artificial
  MsCOMT deletion introduced by TALEN pair MsCOMT_T02.1
tctcacaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10367 - DNA, 258 bp, Artificial
  MsCOMT deletion introduced by TALEN pair MsCOMT_T02.1
tctcacaaacctcatcaatcacaaccatgggttcaacaggtgaaactcaaataacaccaacccacatatcagatgaagaagcaaacctcttcgccatgcaattagcaagtgcttcagttcttcccataaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10368 - DNA, 353 bp, Artificial
  MsCOMT deletion introduced by TALEN pair MsCOMT_T02.1
tctcacaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10369 - DNA, 358 bp, Artificial
  MsCOMT deletion introduced by TALEN pair MsCOMT_T02.1
tctcacaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10370 - DNA, 351 bp, Artificial
  MsCOMT deletion introduced by TALEN pair MsCOMT_T02.1
tctcacaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10371 - DNA, 356 bp, Artificial
  MsCOMT deletion introduced by TALEN pair MsCOMT_T02.1
tctcacaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10372 - DNA, 357 bp, Artificial
  MsCOMT deletion introduced by TALEN pair MsCOMT_T02.1
tctcacaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10373 - DNA, 353 bp, Artificial
  MsCOMT deletion introduced by TALEN pair MsCOMT_T02.1
tctcacaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10374 - DNA, 358 bp, Artificial
  MsCOMT deletion introduced by TALEN pair MsCOMT_T02.1
tctcacaaacctatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10375 - DNA, 360 bp, Artificial
  MsCOMT deletion introduced by TALEN pair MsCOMT_T02.1
tctcacaaacacctcatcaatcacaacaatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaagtgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10376 - DNA, 361 bp, Artificial
  MsCOMT deletion introduced by TALEN pair MsCOMT_T02.1
tctcacaaaatcctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10377 - DNA, 356 bp, Artificial
  MsCOMT deletion introduced by TALEN pair MsCOMT_T02.1
tctcacaaaatcctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10378 - DNA, 361 bp, Artificial
  MsCOMT deletion introduced by TALEN pair MsCOMT_T02.1
tctcacaaaatcctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 10379 - DNA, 362 bp, Artificial
  MsCOMT deletion introduced by TALEN pair MsCOMT_T02.1
tctcacaaaatcctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagacggaaaggttcagagactttatggtttggctactgttgctaa

SEQ ID NO: 10380 - DNA, 358 bp, Artificial
  MsCOMT deletion introduced by TALEN pair MsCOMT_T02.1
tctcacaaaatcctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10381 - DNA, 359 bp, Artificial
  MsCOMT deletion introduced by TALEN pair MsCOMT_T02.1
tctcacaaaatcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatcactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10382 - DNA, 353 bp, Artificial
  MsCOMT deletion introduced by TALEN pair MsCOMT_T02.1
tctcacaaaagcctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10383 - DNA, 361 bp, Artificial
  MsCOMT deletion introduced by TALEN pair MsCOMT_T02.1
tctcacaaaagcctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10384 - DNA, 356 bp, Artificial
  MsCOMT deletion introduced by TALEN pair MsCOMT_T02.1
tctcacaaaactcatcaatcacaaccatgggttcaacaggtgcaactcacataacaccaacccacatatcagatgaagaagccaacctcttcgccattcaactagcaagtgcttcagttcttcccatgattttgaaatcagctcttgaacttgatctcttagaaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10385 - DNA, 361 bp, Artificial
  MsCOMT deletion introduced by TALEN pair MsCOMT_T02.1
tctcacaaaactcatcaatcacaaccatgggttcaacaggtgcaactcaaataacaccaacccacatatcagatgaagaagcaaacctcttcgccatgcaattagcaagtgcttcagttcttcccatgattttaaaatcagctcttgaacttgatctcttagaaatcattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10386 - DNA, 359 bp, Artificial
  MsCOMT deletion introduced by TALEN pair MsCOMT_T02.1
tctcacaaaactcatcaatcacaaccatgggttcaacaggtgaaactcaaataacaccaacccacatatcagatgaagaagccaacctcttcgccatgcaattagcaagtgcttcagttcttcccatgattttaaaatcagctcttgaacttgatctcttagaaatctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 10387 - DNA, 349 bp, Artificial
  MsCOMT deletion introduced by TALEN pair MsCOMT_T02.1
tctcacaaaactcatcaatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10388 - DNA, 358 bp, Artificial
  MsCOMT deletion introduced by TALEN pair MsCOMT_T02.1
tctcacaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10389 - DNA, 357 bp, Artificial
  MsCOMT deletion introduced by TALEN pair MsCOMT_T02.1
tctcacaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10390 - DNA, 355 bp, Artificial
  MsCOMT deletion introduced by TALEN pair MsCOMT_T02.1
tctcacaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10391 - DNA, 351 bp, Artificial
  MsCOMT deletion introduced by TALEN pair MsCOMT_T02.1
tctcacaaaactcataatcacaaccatgggttcaacaggtgaaactcaaataacaccaacccacatatcagatgaagaagcacacctcttcgccatgcaattagcaagtgcttcagttcttcccatgattttgaaatcagctcttgaacttgatctcttagaaattggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10392 - DNA, 357 bp, Artificial
  MsCOMT deletion introduced by TALEN pair MsCOMT_T02.1
tctcacaaaacctctcaatcacaaccatgggttcaacaggtgcaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10393 - DNA, 220 bp, Artificial
  MsCOMT deletion introduced by TALEN pair MsCOMT_T02.1
tctcacaaaacctctcaatcacaaccatgggttcaacaggtgaaactcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10394 - DNA, 356 bp, Artificial
  MsCOMT deletion introduced by TALEN pair MsCOMT_T02.1
tctcacaaaacctcctcaatcacaaccattggttcaacaggtgaaactcaaataacaccaacccacatatcagatgaagaagcaaacctcttcgccatgcaattagcaagtgcttcagttcttcccatgattttgaaatcagctcttgaacttgatctcttagataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttactaa

SEQ ID NO: 10395 - DNA, 360 bp, Artificial
  MsCOMT deletion introduced by TALEN pair MsCOMT_T02.1
tctcacaaaacctcctcaatcacaaccatgggttcaacaggtgaaactcaaatcacaccaacccacatatcagatgaagaagcaaacctcttcgccatgcaattagcaagtgcttcagttcttcccatgattttgaaatcagctcttgaacttgatctcttagaaacataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10396 - DNA, 356 bp, Artificial
  MsCOMT deletion introduced by TALEN pair MsCOMT_T02.1
tctcacaaaacctcctcaatcacaaccatgggttcaacaggtgaaactcaaatcacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10397 - DNA, 360 bp, Artificial
  MsCOMT deletion introduced by TALEN pair MsCOMT_T02.1
tctcacaaaacctcctcaatcacaaccatgggttcaacaggtgaaactcaaatcacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10398 - DNA, 348 bp, Artificial
  MsCOMT deletion introduced by TALEN pair MsCOMT_T02.1
tctcacaaaacctcctcaatcacaaccatgggttcaacaggtgaaactcaaatcacaccaacccacatatcagatgaagaagcaaacctcttcgccatgcaactagcaagtgcttcagttcttcccatgattttaaaatcagctcttgaacattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10399 - DNA, 216 bp, Artificial
  MsCOMT deletion introduced by TALEN pair MsCOMT_T02.1
tctcacaaaacctcctcaatcacaaccatgggttcaacaggtgaaactcaaataacaccaacccacatatcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 10400 - DNA, 361 bp, Artificial
  MsCOMT deletion introduced by TALEN pair MsCOMT_T02.1
tctcacaaaacctcctcaatcacaaccatgggttcaacaggtgaaactcaaataacaccaacccacatatcagatgaagaagcaaacctcttcgccattcaattagcaagtgcttcagttcttcccatgattttaaaatcagctcttgaacttgatctcttagaaatcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10401 - DNA, 358 bp, Artificial
  MsCOMT deletion introduced by TALEN pair MsCOMT_T02.1
tctcacaaaacctcctcaatcacaaccatgggttcaacaggtgaaactcaaataacaccaacccacatatcagatgaagaagcaaacctcttcgccattcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 10402 - DNA, 356 bp, Artificial
  MsCOMT deletion introduced by TALEN pair MsCOMT_T02.1
tctcacaaaacctcctcaatcacaaccatgggttcaacaggtgaaactcaaataacaccaacccacatatcagatgaagaagcaaacctcttcgccattcaattagcaagtgcttcagttcttcccatgattttaaaatcagctcttgaacttgatctcttagaaaaagctggacctggtgctcaaatttcacctattgaaattgcttctcagctcccaacaactaaccctgatacaccagttatgttggaccgaatgttgcgtctcttggcttgttacaatatcctcacttgttcagttcgtactcaacaagatggaaaggttcagagactttatggtttggctactgttgctaa

SEQ ID NO: 10403 - DNA, 351 bp, Artificial
  MsCOMT deletion introduced by TALEN pair MsCOMT_T02.1
tctcacaaaacctcctcaatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttaggctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10404 - DNA, 345 bp, Artificial
  MsCOMT deletion introduced by TALEN pair MsCOMT_T02.1
tctcacaaaacctcctcaatcacaaccatgggttcaacaggtgaaactcaaataacaccaacccacatatcagatgaagaagcaaacctcttcgccattcaactagcaagtgcttcagttcttcccatgattctgaaatcagctcttgaacttgatctcttagaatggtgctcaaatttcacctattgaaattgcttctcagctaccaacaactaaccctgatgcaccagttatgttggaccgaatgttgcgtctcttggcttgttacaatatcctcacttgttcagttcgtactcaagaagatggaaaggttcagagactttatggtttggctactgttgctaa

SEQ ID NO: 10405 - DNA, 309 bp, Artificial
  MsCOMT deletion introduced by TALEN pair MsCOMT_T02.1
tctcacaaaacctcctcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10406 - DNA, 358 bp, Artificial
  MsCOMT deletion introduced by TALEN pair MsCOMT_T02.1
tctcacaaaacctcctcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10407 - DNA, 347 bp, Artificial
  MsCOMT deletion introduced by TALEN pair MsCOMT_T02.1
tctcacaaaacctcctcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10408 - DNA, 357 bp, Artificial
  MsCOMT deletion introduced by TALEN pair MsCOMT_T02.1
tctcacaaaacctcctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctattgaaattgcttctcagctcccaacaactaaccctgatgcaccagttatgttggaccgaatgttgcgtctcttggcgtgttacaatatcctcacttgttcagttcgtactcaacaagatggaaaagttcagagactttatggtttggctactgttgctaa

SEQ ID NO: 10409 - DNA, 348 bp, Artificial
  MsCOMT deletion introduced by TALEN pair MsCOMT_T02.1
tctcacaaaacctcctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10410 - DNA, 358 bp, Artificial
  MsCOMT deletion introduced by TALEN pair MsCOMT_T02.1
tctcacaaaacctcctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10411 - DNA, 356 bp, Artificial
  MsCOMT deletion introduced by TALEN pair MsCOMT_T02.1
tctcacaaaacctcctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10412 - DNA, 338 bp, Artificial
  MsCOMT deletion introduced by TALEN pair MsCOMT_T02.1
tctcacaaaacctcctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctgtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10413 - DNA, 357 bp, Artificial
  MsCOMT deletion introduced by TALEN pair MsCOMT_T02.1
tctcacaaaacctcatcatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10414 - DNA, 359 bp, Artificial
  MsCOMT deletion introduced by TALEN pair MsCOMT_T02.1
tctcacaaaacctcatcaatcacaaccattggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgatcagttcgtactcaacaagatggaaaggttcagagactttatggtttggctactgttgctaa

SEQ ID NO: 10415 - DNA, 351 bp, Artificial
  MsCOMT deletion introduced by TALEN pair MsCOMT_T02.1
tctcacaaaacctcatcaatcacaaccattggttcaacaggtgaaactcaaataacaccaacccacatatcagatgaagaagcaaacctcttcgccatgcaactagcaagtgcttcagttcttcccatgattttgaaatcagctcttgaacttgatctctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10416 - DNA, 465 bp, Artificial
  MsCOMT deletion introduced by TALEN pair MsCOMT_T02.1
tctcacaaaacctcatcaatcacaaccattggttcaacaggtgaaactcaaataacaccaacccacatatcagatgaagaagaaaacctcttcgccatgcaactagcaagtgcttcagttcttcccatgattttgaaatcagctcttgaacttgatctcttagaaatcaggcgctggagacggtgcaggcgctgttgccggtgctgtgccaggcccacggcttgaccccggagcaggtggtggccatcgccagcaatattggtggcaagcaggcgctggacgacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10417 - DNA, 360 bp, Artificial
  MsCOMT deletion introduced by TALEN pair MsCOMT_T02.1
tctcacaaaacctcatcaatcacaaccatgggttcaacgggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10418 - DNA, 362 bp, Artificial
  MsCOMT deletion introduced by TALEN pair MsCOMT_T02.1
tctcacaaaacctcatcaatcacaaccatgggttcaacaggtgaaactccaatcacaccaacccacatatcagatgaagaagcaaacctcttcgccatgcaattagcaagtgcttcagttcttcccatgattttaaaatcagctcttgaacctgatctcttagaaatcattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10419 - DNA, 360 bp, Artificial
  MsCOMT deletion introduced by TALEN pair MsCOMT_T02.1
tctcacaaaacctcatcaatcacaaccatgggttcaacaggtgaaactccaatcacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10420 - DNA, 358 bp, Artificial
  MsCOMT deletion introduced by TALEN pair MsCOMT_T02.1
tctcacaaaacctcatcaatcacaaccatgggttcaacaggtgaaactccaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10421 - DNA, 358 bp, Artificial
  MsCOMT deletion introduced by TALEN pair MsCOMT_T02.1
tctcacaaaacctcatcaatcacaaccatgggttcaacaggtgaaactccaataacaccaacccacatatcagatgaagaagcaaacctcttcgccatgcaattagcaagtgcttcagttcttcccatgattttaaaatcagctcttgaacttgatcccttagaactaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10422 - DNA, 354 bp, Artificial
  MsCOMT deletion introduced by TALEN pair MsCOMT_T02.1
tctcacaaaacctcatcaatcacaaccatgggttcaacaggtgaaactccaataacaccaacccacatatcagatgaagaagcaaacctcttcgccatgcaactagcaagtgcttcagttcttcccatgattttgaaatcagctcttgaacttgatctcttagaaatctggacctggtgctcaaatttcacctattgaaattgcttctcagctaccaacaactaaccctgatgcaccagttatgttggaccgaatgttgcgtctctttgcttgttacaatatcctcacttgttcagttcgtactcaacaagatggaaaggttcagagactttatggtttggctactgttgctaa

SEQ ID NO: 10423 - DNA, 360 bp, Artificial
  MsCOMT deletion introduced by TALEN pair MsCOMT_T02.1
tctcacaaaacctcatcaatcacaaccatgggttcaacaggtgaaactccaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10424 - DNA, 354 bp, Artificial
  MsCOMT deletion introduced by TALEN pair MsCOMT_T02.1
tctcacaaaacctcatcaatcacaaccatgggttcaacaggtgaaactccaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10425 - DNA, 355 bp, Artificial
  MsCOMT deletion introduced by TALEN pair MsCOMT_T02.1
tctcacaaaacctcatcaatcacaaccatgggttcaacaggtgaaactcaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctctgttgctaa

SEQ ID NO: 10426 - DNA, 359 bp, Artificial
  MsCOMT deletion introduced by TALEN pair MsCOMT_T02.1
tctcacaaaacctcatcaatcacaaccatgggttcaacaggtgaaactcaaatcacaccaacccacatatcagatgaagaagcaaacctcttcgccattcaattagcaagtgcttcagttcttcccatgattttaaaatcagctcttgaacttgatctcttagaaattaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 10427 - DNA, 361 bp, Artificial
  MsCOMT deletion introduced by TALEN pair MsCOMT_T02.1
tctcacaaaacctcatcaatcacaaccatgggttcaacaggtgaaactcaaatcacaccaacccacatatcagatgaagaagcaaacctcttcgccattcaattagcaagtgcttcagttcttcccatgattttaaaatcagctcttgaacttgatctcttagaaatgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10428 - DNA, 356 bp, Artificial
  MsCOMT deletion introduced by TALEN pair MsCOMT_T02.1
tctcacaaaacctcatcaatcacaaccatgggttcaacaggtgaaactcaaatcacaccaacccacatatcagatgaagaagcaaacctcttcgccatgcaattagcaagtgcttcagttcttcccatgattttgaaatcagctcttgaacttgatctcttagaaatcgctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 10429 - DNA, 358 bp, Artificial
  MsCOMT deletion introduced by TALEN pair MsCOMT_T02.1
tctcacaaaacctcatcaatcacaaccatgggttcaacaggtgaaactcaaatcacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagctcccgacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10430 - DNA, 358 bp, Artificial
  MsCOMT deletion introduced by TALEN pair MsCOMT_T02.1
tctcacaaaacctcatcaatcacaaccatgggttcaacaggtgaaactcaaatcacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10431 - DNA, 319 bp, Artificial
  MsCOMT deletion introduced by TALEN pair MsCOMT_T02.1
tctcacaaaacctcatcaatcacaaccatgggttcaacaggtgaaactcaaatcacaccaacccacatatcagatgaagaagcaaacctcttcgccatgcaactagcaagtgcttcagttcttcccatgattttgaaatcagctcttgaacttgatctcttgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10432 - DNA, 357 bp, Artificial
  MsCOMT deletion introduced by TALEN pair MsCOMT_T02.1
tctcacaaaacctcatcaatcacaaccatgggttcaacaggtgaaactcaaatcacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10433 - DNA, 352 bp, Artificial
  MsCOMT deletion introduced by TALEN pair MsCOMT_T02.1
tctcacaaaacctcatcaatcacaaccatgggttcaacaggtgaaactcaaatcacaccaacccacatatcagatgaagaagcaaacctcttcgccatgcaactagcaagtgcttcagttcttcccatgattttgaaatcagctcttgaacttgatctcttagaacttgacctggtgctcaaatttcacctattgaaattgcttctcagctcccaacaactaaccctgatgcaccagttatgttgtaccgaatgttgcgtctcttggcttgttacaatatcctcacttgttcagttcgtactcaacaagatggaaaggttcagagactttatggtttggctactgttgctaa

SEQ ID NO: 10434 - DNA, 444 bp, Artificial
  MsCOMT deletion introduced by TALEN pair MsCOMT_T02.1
tctcacaaaacctcatcaatcacaaccatgggttcaacaggtgaaactcaaatcacaccaacccacatatcagatgaagaagcaaacctcttcgccatgcaactagcaagtgcttcagttcttcccatgattttgaaatcagctcttgaacttgatctcttagaaatctgttgccggtgctgtgccaggcccacggcttgaccccggagcaggtggtggccatcgccagccacgatggcggcaagcaggcgctggagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10435 - DNA, 356 bp, Artificial
  MsCOMT deletion introduced by TALEN pair MsCOMT_T02.1
tctcacaaaacctcatcaatcacaaccatgggttcaacaggtgaaactcaaatcacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10436 - DNA, 321 bp, Artificial
  MsCOMT deletion introduced by TALEN pair MsCOMT_T02.1
tctcacaaaacctcatcaatcacaaccatgggttcaacaggtgaaactcaaatcacaccaacccacatatcagatgaagaagcaaacctcttcgccatgcaactagcaagtgcttcagttcttcccatgattttgaaatcagctcttgaacttgatctctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10437 - DNA, 351 bp, Artificial
  MsCOMT deletion introduced by TALEN pair MsCOMT_T02.1
tctcacaaaacctcatcaatcacaaccatgggttcaacaggtgaaactcaaatcacaccaacccacatatcagatgaagaagcaaacctcttcgccatgcaactagcaagtgcttcagttcttcccatgattttgaaatcagctcttgaacttgatctctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10438 - DNA, 355 bp, Artificial
  MsCOMT deletion introduced by TALEN pair MsCOMT_T02.1
tctcacaaaacctcatcaatcacaaccatgggttcaacaggtgaaactcaaatcacaccaacccacatatcagatgaagaagcaaacctcttcgccatgcaactagcaagtgcttcagttcttcccatgattttgaaatcagctcttgaactcgatctcttagaaatcatggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10439 - DNA, 294 bp, Artificial
  MsCOMT deletion introduced by TALEN pair MsCOMT_T02.1
tctcacaaaacctcatcaatcacaaccatgggttcaacaggtgaaactcaaatcacaccaacccacatatcagatgaagaagcaaacctcttcgccatgcaactagcaagtgcttcagttcttcccatgattttgaaatcagctcttgaacctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10440 - DNA, 335 bp, Artificial
  MsCOMT deletion introduced by TALEN pair MsCOMT_T02.1
tctcacaaaacctcatcaatcacaaccatgggttcaacaggtgaaactcaaatcacaccaacccacatatcagatgaagaagcaaacctcttcgccatgcaactagcaagtgcttcagttcttcccatgattttgaaatcagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10441 - DNA, 360 bp, Artificial
  MsCOMT deletion introduced by TALEN pair MsCOMT_T02.1
tctcacaaaacctcatcaatcacaaccatgggttcaacaggtgaaactcaaatcacaccaacccacatatcagatgaagaagcaaacctcttcgccatgcaactagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10442 - DNA, 361 bp, Artificial
  MsCOMT deletion introduced by TALEN pair MsCOMT_T02.1
tctcacaaaacctcatcaatcacaaccatgggttcaacaggtgaaactcaaatcacaccaacccacatatcagatgaagaagcaaacctcttcgccatgcaactagcaagtgcttcagttcttcccatgattttaaaatcagctcttgaacttgatctcttagaaatcataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10443 - DNA, 351 bp, Artificial
  MsCOMT deletion introduced by TALEN pair MsCOMT_T02.1
tctcacaaaacctcatcaatcacaaccatgggttcaacaggtgaaactcaaatcacaccaacccacatatcagatgaagaagcaaacctcttcgccatgcaactagcaagtgcttcagttcttcccatgattttaaaatcagctcttgaacttgatctctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10444 - DNA, 358 bp, Artificial
  MsCOMT deletion introduced by TALEN pair MsCOMT_T02.1
tctcacaaaacctcatcaatcacaaccatgggttcaacaggtgaaactcaaataacaccaacccacttatcagatgaagaagcaaacctcttcgccatgcaattagcaagtgcttcagttcttcccatgattttaaaatcatctcttgaacttgatctcttagaaattaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 10445 - DNA, 216 bp, Artificial
  MsCOMT deletion introduced by TALEN pair MsCOMT_T02.1
tctcacaaaacctcatcaatcacaaccatgggttcaacaggtgaaactcaaataacaccaacccacatattagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 10446 - DNA, 358 bp, Artificial
  MsCOMT deletion introduced by TALEN pair MsCOMT_T02.1
tctcacaaaacctcatcaatcacaaccatgggttcaacaggtgaaactcaaataacaccaacccacatattagatgaagaagcaaacctcttcgccatgcaattagcaagtgcttcagttcttcccatgattttaaaatcagctcttgaacttgatctcttagaaataaagctgaacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10447 - DNA, 286 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagcagcaaacctcttcgccattcaattagcaagtgcttcagttcttcccatgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10448 - DNA, 364 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgtcatgcaattagcaagtgcttcagttcttcccatgattttaaaatcagctcttgaacttgatctcttagaaatcatgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10449 - DNA, 357 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccgtgcaactagcaagtgcttcagttcttcccatgattttaaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10450 - DNA, 353 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccattcaattagcaagtgcttcagttcttcccatgattttgaaatcagctcttgaacttgatctcttagaagctggacctggtgctcaaatttcacctattgaaattgcctctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10451 - DNA, 359 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccattcaattagcaagtgcttcagttcttcccatgattttgaaatcagctcttgaacttgatctcttagaaagtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10452 - DNA, 354 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccattcaattagcaagtgcttcagttcttcccatgattttgaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcccttgttcagttcgtactcaacaagatggaaaagttcagagactttatggtttggctactgttgctaa

SEQ ID NO: 10453 - DNA, 356 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccattcaattagcaagtgcttcagttcttcccatgattttgaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10454 - DNA, 353 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccattcaattagcaagtgcttcagttcttcccatgattttaaaatcatctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10455 - DNA, 357 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccattcaattagcaagtgcttcagttcttcccatgattttaaaatcagctcttgaacttgatctcttagactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10456 - DNA, 353 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccattcaattagcaagtgcttcagttcttcccatgattttaaaatcagctcttgaacttgatctcttagaagctggacctggtgctcaaatttcacctattgaaattgcttctcagctcccaacaactaaccctgatgtaccagttatgttggaccgaatgttgcgtctcttggcttgttacaatatcctcacttgttcagttcgtactcaacaagatggaaaggttcagagactttatggtttggctactgttgctaa

SEQ ID NO: 10457 - DNA, 362 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccattcaattagcaagtgcttcagttcttcccatgattttaaaatcagctcttgaacttgatctcttagaaatcattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10458 - DNA, 354 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccattcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10459 - DNA, 351 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccattcaattagcaagtgcttcagttcttcccatgattttaaaatcagctcttgaacttgatctcttaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10460 - DNA, 355 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccattcaattagcaagtgattcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10461 - DNA, 360 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttagaaattgctaaatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10462 - DNA, 359 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10463 - DNA, 360 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10464 - DNA, 360 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 10465 - DNA, 358 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctacgttgctaa

SEQ ID NO: 10466 - DNA, 358 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10467 - DNA, 358 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10468 - DNA, 354 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10469 - DNA, 360 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttagaaaattaaagctggacctggtgctcaaatttcacctattgaaattgcttctcagctcccaacaactaaccctgatgcaccagttatgttgtaccgaatgttgcgtctcttggcttgttacaatatcctcacttgttcagttcgtactcaacaagatggaaagattcagagactttatggtttggctactgttgctaa

SEQ ID NO: 10470 - DNA, 355 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10471 - DNA, 357 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttagaaaaaagctggacctggtactcaaatttcacctattgaaattgcttctcagctcccaacaactaaccctgatgcaccagttatgttgggctgaatgttgcgtctcttggcttgttacaatatcctcacttgttcagttcgtactcaacaagatggaaaggttcagagactttatggtttggctactgttgctaa

SEQ ID NO: 10472 - DNA, 360 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgtaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10473 - DNA, 355 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgcttttaaaatcagctcttgaacttgatctcttagaaatgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10474 - DNA, 292 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10475 - DNA, 354 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttgaaatcatctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10476 - DNA, 338 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagtttcagagactttatggtttggctactgttgctaa

SEQ ID NO: 10477 - DNA, 340 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagtgctcaaatttcacctattgaaattgcttctcagctaccaacaactaaccctgatgcaccagttatgttggaccgaatgttgtgtctcttggcttgttacaatatcctcacttgttcagttcgtactcaacaagatggaaaagttcagagactttatggtttggctactgttgctaa

SEQ ID NO: 10478 - DNA, 354 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagtaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggcactgttgctaa

SEQ ID NO: 10479 - DNA, 356 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10480 - DNA, 357 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10481 - DNA, 353 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10482 - DNA, 346 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10483 - DNA, 354 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctggacctggtgctcaaatttcacctattgaaattgcttctcagctaccaacaactaaccctgatgcaccagttatgttggaccgaatgttgcgtctcgtggcttgatacaatatcatcacttgtccagttcgtactcaacaagatggaaaggttcagagactttatggtttggctactggtgctaa

SEQ ID NO: 10484 - DNA, 360 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10485 - DNA, 360 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10486 - DNA, 246 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatacaatatcctcacttgttcagttcgtactcaacaagatggaaaggttcagagactttatggtttggctactgttgctaa

SEQ ID NO: 10487 - DNA, 358 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaactagatggaaaggttcagagactttatggtttggctactgttgctaa

SEQ ID NO: 10488 - DNA, 353 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10489 - DNA, 355 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10490 - DNA, 352 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10491 - DNA, 349 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10492 - DNA, 348 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10493 - DNA, 340 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10494 - DNA, 305 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttgaaatcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10495 - DNA, 357 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcatctcttgaacttgatctcttaggctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 10496 - DNA, 344 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10497 - DNA, 340 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10498 - DNA, 425 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttgctggggggtcaagccgtgggcctggcacagcaccggcaacagccgctggaccgtctccagcgcctgcttgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10499 - DNA, 355 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagtaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10500 - DNA, 357 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaggctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10501 - DNA, 350 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10502 - DNA, 356 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10503 - DNA, 356 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10504 - DNA, 349 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagactacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10505 - DNA, 358 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaattaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 10506 - DNA, 358 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10507 - DNA, 360 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatcataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 10508 - DNA, 357 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10509 - DNA, 353 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10510 - DNA, 358 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10511 - DNA, 359 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaacataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10512 - DNA, 360 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatttaaagctggacctggtgctcaaatttcacctattgaaattgcttctcagctcccaacaactaaccctgatgcaccagttatgtcggaccgaatgttgcgtctcttggcttgttacaatatcctcacttgttcagttcgtactcaacaagatggaaagattcagagactttatggtttggctactgttgctaa

SEQ ID NO: 10513 - DNA, 352 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgtgctaa

SEQ ID NO: 10514 - DNA, 361 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10515 - DNA, 358 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10516 - DNA, 359 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 10517 - DNA, 359 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10518 - DNA, 359 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10519 - DNA, 359 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgatggaccgaatgttgcgtctcttggcttgttacaatatcctcacttgttcagttcgtactcaacaagatggaaagattcagagactttatggtttggctactgttgctaa

SEQ ID NO: 10520 - DNA, 359 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggtccgaatgttgcgtctcttggcttgttacaatatcctcacttgttcagttcgtactcaacaagatggaaaagttcagagactttatggtttggctactgttgctaa

SEQ ID NO: 10521 - DNA, 359 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 10522 - DNA, 359 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10523 - DNA, 354 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10524 - DNA, 354 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10525 - DNA, 356 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10526 - DNA, 359 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10527 - DNA, 360 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10528 - DNA, 360 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 10529 - DNA, 360 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10530 - DNA, 360 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10531 - DNA, 360 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10532 - DNA, 360 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10533 - DNA, 360 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagatcccaacaactaaccctgatgcaccagttatgttggaccgaatgttgcgtctcttggcttgttacaatatcctcccttgttcagttcgtactcaacaagatggaaagattcagagactttatggtttggctactgttgctaa

SEQ ID NO: 10534 - DNA, 360 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcgtctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10535 - DNA, 362 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10536 - DNA, 361 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10537 - DNA, 356 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10538 - DNA, 311 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10539 - DNA, 362 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10540 - DNA, 362 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10541 - DNA, 362 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10542 - DNA, 355 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 10543 - DNA, 361 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10544 - DNA, 357 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10545 - DNA, 389 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcagcaatggcggcggcaggccggcgctggctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10546 - DNA, 351 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10547 - DNA, 358 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtactcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10548 - DNA, 359 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10549 - DNA, 359 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10550 - DNA, 359 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10551 - DNA, 360 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10552 - DNA, 360 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10553 - DNA, 356 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10554 - DNA, 358 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 10555 - DNA, 358 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaatttcttctcagctcccaacaactaaccctgatgaaccacttatgttggaccgaatgttgcgtctcttggcttgttacaatatcctcacttgttcagttcgtactcaacaagatggaaagattcagagactttatggtttggctactgttgctaa

SEQ ID NO: 10556 - DNA, 358 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10557 - DNA, 358 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10558 - DNA, 358 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccaattatgttggaccgaatgttgcgtctcttggcttgttacaatatcctcacttgttcagttcgtactcaacaagatggaaaggttcagagactttatggtttggctactgttgctaa

SEQ ID NO: 10559 - DNA, 358 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtactcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 10560 - DNA, 354 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 10561 - DNA, 354 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10562 - DNA, 354 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10563 - DNA, 354 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10564 - DNA, 354 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10565 - DNA, 360 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10566 - DNA, 359 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10567 - DNA, 355 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10568 - DNA, 355 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactgtatggtttggctactgtggctaa

SEQ ID NO: 10569 - DNA, 355 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10570 - DNA, 355 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 10571 - DNA, 356 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10572 - DNA, 356 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10573 - DNA, 304 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10574 - DNA, 357 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 10575 - DNA, 351 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 10576 - DNA, 352 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10577 - DNA, 352 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgtacagttcgtactcaacaagatggaaaggttcagagactttatggtttggctactgttgctaa

SEQ ID NO: 10578 - DNA, 338 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctgtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10579 - DNA, 321 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10580 - DNA, 351 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaaagctgtacctggtgctcaaatttcacctattgaaattgcttctcagctcccaacaactaaccctgatgcaccagttatgttggaccgaatgttgcgtctcttggcttgttacaatttcctcacttgttcagttcgtactcaacaagatggaaagattcagagactttatggtttggctactgttgctaa

SEQ ID NO: 10581 - DNA, 351 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10582 - DNA, 351 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10583 - DNA, 351 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10584 - DNA, 351 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 10585 - DNA, 341 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10586 - DNA, 349 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10587 - DNA, 286 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcttcagttcttcccatgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10588 - DNA, 358 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaattagcaagtgcgtcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10589 - DNA, 292 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10590 - DNA, 292 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10591 - DNA, 332 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10592 - DNA, 359 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcatctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10593 - DNA, 343 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10594 - DNA, 354 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10595 - DNA, 354 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 10596 - DNA, 340 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagtgctcaaatttcacctattgaaattgcttctcagctaccaacaactaaccctgatgcaccagttatgttggaccgaatgttgcgtctcttggcttgttacaatatcctcacttgttcagttcgtactaaacaagatggaaaagttcagagactttatggtttgggtactgttgctaa

SEQ ID NO: 10597 - DNA, 355 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 10598 - DNA, 355 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10599 - DNA, 355 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10600 - DNA, 356 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10601 - DNA, 356 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10602 - DNA, 357 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10603 - DNA, 351 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10604 - DNA, 360 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaatcataaagctggacctggtgctcaaatttcacctgttcaaattgcttctcagcttccaacaactaaccctgatgcaccagtcatgttggaccgaatgttgcgtctcttgacttgttacaatatcctcacttgttctgttcgtactcaacaagatggaaaggttcagagactttatggtttggctactgttgctaa

SEQ ID NO: 10605 - DNA, 357 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10606 - DNA, 357 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10607 - DNA, 357 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10608 - DNA, 353 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 10609 - DNA, 352 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10610 - DNA, 352 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10611 - DNA, 358 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaactaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 10612 - DNA, 360 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10613 - DNA, 309 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10614 - DNA, 359 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 10615 - DNA, 359 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10616 - DNA, 359 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10617 - DNA, 359 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10618 - DNA, 359 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10619 - DNA, 359 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtactcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10620 - DNA, 346 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatggtgctcaaatttcacctattgaaattgcttctcagctaccaacaactaaccctgaagcaccagttatgttggaccgaatgttgcgtctcttggcttgttacaatatcctcacttgttcagttcgtactcaacaagatggaaaggttcagagactttatggtttggctactgttgctaa

SEQ ID NO: 10621 - DNA, 361 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10622 - DNA, 354 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10623 - DNA, 354 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10624 - DNA, 360 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10625 - DNA, 360 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10626 - DNA, 360 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10627 - DNA, 360 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10628 - DNA, 360 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcatctcttggcttgttacaatatcctcacttgttcagttcgtactcaacaagatggaaagattcagagactttatggtttggctactgttgctaa

SEQ ID NO: 10629 - DNA, 360 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 10630 - DNA, 426 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcgtcagctgggccttgtagttgcccttgaagcgctggagacggtccagcggctgttgccggtgctgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10631 - DNA, 356 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10632 - DNA, 349 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10633 - DNA, 361 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10634 - DNA, 362 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10635 - DNA, 361 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatacagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 10636 - DNA, 360 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10637 - DNA, 357 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10638 - DNA, 357 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10639 - DNA, 356 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10640 - DNA, 356 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10641 - DNA, 362 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10642 - DNA, 358 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 10643 - DNA, 358 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 10644 - DNA, 358 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10645 - DNA, 359 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10646 - DNA, 360 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10647 - DNA, 360 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10648 - DNA, 360 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10649 - DNA, 360 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10650 - DNA, 360 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10651 - DNA, 246 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatacaatatcctcacttgttcagttcgtactcaacaagatggaaaagttcagagactttatggtttggctactgttgctaa

SEQ ID NO: 10652 - DNA, 357 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10653 - DNA, 357 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10654 - DNA, 358 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10655 - DNA, 358 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10656 - DNA, 358 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10657 - DNA, 358 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10658 - DNA, 358 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10659 - DNA, 354 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10660 - DNA, 359 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 10661 - DNA, 359 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10662 - DNA, 355 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10663 - DNA, 355 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10664 - DNA, 355 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10665 - DNA, 355 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10666 - DNA, 356 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10667 - DNA, 357 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10668 - DNA, 355 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10669 - DNA, 351 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10670 - DNA, 352 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10671 - DNA, 352 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10672 - DNA, 351 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctacgttgctaa

SEQ ID NO: 10673 - DNA, 338 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctgtgctcaaatttcacctattgaaattgcttctcagctcccaacaactaaccctgatgcaccagttatgttggaccgaatgttgcgtctcttggcttgttacaatatcctcgcttgttcagttcgtactcaacaagatggaaaggttcagagactttatggtttggctactgttgctaa

SEQ ID NO: 10674 - DNA, 349 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10675 - DNA, 347 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10676 - DNA, 339 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaactctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagaggctttatggtttggctactgttgctaa

SEQ ID NO: 10677 - DNA, 337 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10678 - DNA, 342 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgtctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10679 - DNA, 350 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10680 - DNA, 353 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10681 - DNA, 359 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10682 - DNA, 359 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10683 - DNA, 346 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10684 - DNA, 355 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatgctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10685 - DNA, 360 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcggagactttatggtttggctactgttgctaa

SEQ ID NO: 10686 - DNA, 357 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10687 - DNA, 359 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10688 - DNA, 358 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10689 - DNA, 359 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10690 - DNA, 359 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaactaaagctggacctggtgctcaaatttcacctattgaaattgcttctcagctaccaacaactaaccctgatgcaccagttatgttggaccgaatgtcgcgtctcttggcttgttacaatatcctcacttgttcagttcgtactcaacaagatggaaaggttcagagactttatggtttggctactgttgctaa

SEQ ID NO: 10691 - DNA, 352 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttaaagctggacctggtgctcaaatttcacctattgaaattgcttctcagctcccaacagctaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10692 - DNA, 352 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10693 - DNA, 342 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10694 - DNA, 233 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactagcaagtgcttcagttatgttggaccgaatgttgcgtctcttggcttgttacaatatcctcacttgttcagttcgtactcaacaagatggaaaggttcagagactttatggtttggctactgttgctaa

SEQ ID NO: 10695 - DNA, 235 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10696 - DNA, 355 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatgcaactaacaagtgcttcagttcttcccatgattttgaaatcagctcttgaacttgatctcttagaaatcatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10697 - DNA, 291 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10698 - DNA, 291 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10699 - DNA, 354 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatccaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10700 - DNA, 355 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccatacaattagcaagtgcttcagttcttctcatgattttaaaatcagctcttgaacttgatctcttaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10701 - DNA, 360 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagcaaacctcttcgccacgcaattagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10702 - DNA, 362 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagaaaacctcttcgccatgcaattagcaagtgcttcagttcttcccatgattttaaaatcagctcttgaacttgatctcttagaaatcactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10703 - DNA, 348 bp, Artificial
  MsCOMT deletion introduced by TALEN pair MsCOMT_T02.1
tctcacaaaacctcatcaatcacaaccatgggttcaacaggtgaaactcaaataacaccaacccacatatcagatgaagaagaaaacctcttcgccatgcaactagcaagtgcttcagttcttcccatgattttgaaatcagctcttgaacttgatctcttagaaacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10704 - DNA, 357 bp, Artificial
  MsCOMT deletion introduced by TALEN pair MsCOMT_T02.1
tctcacaaaacctcatcaatcacaaccatgggttcaacaggtgaaactcaaacaacaccaacccacatatcagatgaagaagaaaacctcttcgccatgcaattagcaaggtcttcagttcttcccatgattttaaaatcagctcttgaacttgatctcttagaaatcagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaagttcagagactttatggtttggctactgttgctaa

SEQ ID NO: 10705 - DNA, 353 bp, Artificial
  MsCOMT deletion introduced by TALEN pair MsCOMT_T02.1
tctcacaaaacctcatcaatcacaaccatgggttcaacaggtgaaacccaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctgttcaaattgcttctcagcttccaacaactaaccctgatgcaccagtcatgttggaccgaatgttgcgtctcttggcttgttacaaaatcctcacttgttcagttcgtactcaacaagatggaaaggttcagagactttatggtttggctactgttgctaa

SEQ ID NO: 10706 - DNA, 355 bp, Artificial
  MsCOMT deletion introduced by TALEN pair MsCOMT_T02.1
tctcacaaaacctcatcaatcacaaccatgggttcaacaggggaaactcaaataacaccaacccacatatcatatgaagaagcaaacctcttcgccatgcaactagcaagtgcttcagttcttcccatgattttgaaatcagctcttgaacttgatctcttagtaaagctggacctggtgctcaaatttcacctattgaaattgcttctcagctcccaacaactaaccctgatgcaccagttatgttggaccgaatgttgcgtctcttggcatgttacaatatcctcacttgttcagttcgtactcaacaagatggaaagattcagagactttatggtttggctactgttgctaa

SEQ ID NO: 10707 - DNA, 358 bp, Artificial
  MsCOMT deletion introduced by TALEN pair MsCOMT_T02.1
tctcacaaaacctcatcaatcacaaccatgggttcaacaggagaaactccaataacaccaacccacatatcagatgaagaagcaaacctcttcgccatgcaactagcaaattcttcagttcttcccatgattttgaaatcaactctttaacttgatctcttataattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10708 - DNA, 358 bp, Artificial
  MsCOMT deletion introduced by TALEN pair MsCOMT_T02.1
tctcacaaaacctcatcaatcacaaccatgggttcaacaggagaaactcaaataacaccaacccacatatcagatgaagaagcaaacctcttcgccatgcaactagcaagtgcttcagttcttcccatgattttaaaatcatctcttgaacttgatctcttagaaataaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10709 - DNA, 352 bp, Artificial
  MsCOMT deletion introduced by TALEN pair MsCOMT_T02.1
tctcacaaaacctcatcaatcacaacaatgggttcaacaggtgaaactcaaataacaccaacccacatatcagatgaagaagcaaacctcttcgccatgcaattagcaagtgcttcagttcttcccatgattttaaaatcagctcttgaacttgatctcttagagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10710 - DNA, 357 bp, Artificial
  MsCOMT deletion introduced by TALEN pair MsCOMT_T02.1
tctcacaaaacctcatcaatcacaacaatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10711 - DNA, 355 bp, Artificial
  MsCOMT deletion introduced by TALEN pair MsCOMT_T02.1
tctcacaaaacctcatcaatcacaacaatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10712 - DNA, 358 bp, Artificial
  MsCOMT deletion introduced by TALEN pair MsCOMT_T02.1
tctcacaaaacctcataatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 10713 - DNA, 320 bp, Artificial
  MsCOMT deletion introduced by TALEN pair MsCOMT_T02.1
tctcacaaaacctcacaatcacaaccatgggttcaacaggtgaaactcacataacaccaacccacatatcagatgaagaagcaaacctcttcgtcatgcaactagcaagtgcttcagttcttcccatgattttgaaatcagctcttgaacttgatctctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10714 - DNA, 349 bp, Artificial
  MsCOMT deletion introduced by TALEN pair MsCOMT_T02.1
tctcacaaaacctatcaatcacaaccatgggttcaacaggtgcaactcaaataacaccaacccacatatcagatgaagaagcaaacctcttcgccattcaactagcaagtgcttcagttcttcccatgattttgaaatcagctcttgaacttgatctcttagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10715 - DNA, 358 bp, Artificial
  MsCOMT deletion introduced by TALEN pair MsCOMT_T02.1
tctcacaaaacctatcaatcacaaccatgggttcaacaggtgaaactcaaataccaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10716 - DNA, 292 bp, Artificial
  MsCOMT deletion introduced by TALEN pair MsCOMT_T02.1
tctcacaaaacctatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacctaccaacaactaaccctgatgcaccagttatgttggaccgaatgttgcgtctcttggcttgttacaatatcctcacttgttcagttcgtactcaacaagatggaaagattcagagactttatggtttggcactgttgctaa

SEQ ID NO: 10717 - DNA, 361 bp, Artificial
  MsCOMT deletion introduced by TALEN pair MsCOMT_T02.1
tctcacaaaaccctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctgttcaaattgcttctcagcttccaacaactaaccctgatgcaccagttatgttggaccgaatgttgcgtctcttggcttgttacgatatcctcacttgttcagttcgtactcaacaagatggaaagattcagagactttatggtttggctactgttgctaa

SEQ ID NO: 10718 - DNA, 220 bp, Artificial
  MsCOMT deletion introduced by TALEN pair MsCOMT_T02.1
tctcacaaaacccatcaatcacaaccatgggttcaacaggtgaaacccaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10719 - DNA, 354 bp, Artificial
  MsCOMT deletion introduced by TALEN pair MsCOMT_T02.1
tctcacaaaaccatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10720 - DNA, 358 bp, Artificial
  MsCOMT deletion introduced by TALEN pair MsCOMT_T02.1
tctcacaaaacatcatcaatcacaaccatgggttcaacaggtgaaactcaaataacaccaacccacatatcagatgaagaagcaaacctcttcgccattcaattagcaagtgcttcagttcttcccatgattttaaaatcatctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10721 - DNA, 352 bp, Artificial
  MsCOMT deletion introduced by TALEN pair MsCOMT_T02.1
tctcacaaaacatcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaacaggacctggtgctcaaatttcacctatcgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10722 - DNA, 232 bp, Artificial
  MsCOMT deletion introduced by TALEN pair MsCOMT_T02.1
tctcacaaaacatcaatcacaaccatgggttcaacaggtgaaactcaaataacaccaacccacatatcagatgaagaagcaaacctcttcgccatgcaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10723 - DNA, 362 bp, Artificial
  MsCOMT deletion introduced by TALEN pair MsCOMT_T02.1
tctcacaaaaatctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10724 - DNA, 360 bp, Artificial
  MsCOMT deletion introduced by TALEN pair MsCOMT_T02.1
tctcacaaaaatctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10725 - DNA, 349 bp, Artificial
  MsCOMT deletion introduced by TALEN pair MsCOMT_T02.1
tctcacaaaaatcatcaatcacaaccatgggttcaacaggtgaaactcacataacaccaacccacatatcagatgaagaagcaaacctcttcgccattcaattagcaagtgcttcagttcttcccatgattttaaaatcagctcttgaacttgatctcttagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10726 - DNA, 348 bp, Artificial
  MsCOMT deletion introduced by TALEN pair MsCOMT_T02.1
tctcacaaaaatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10727 - DNA, 355 bp, Artificial
  MsCOMT deletion introduced by TALEN pair MsCOMT_T02.1
tctcacaaaaacttcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgtcgctaa

SEQ ID NO: 10728 - DNA, 361 bp, Artificial
  MsCOMT deletion introduced by TALEN pair MsCOMT_T02.1
tctcacaaaaacttcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10729 - DNA, 359 bp, Artificial
  MsCOMT deletion introduced by TALEN pair MsCOMT_T02.1
tctcacaaaaacttcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgtttctaa

SEQ ID NO: 10730 - DNA, 353 bp, Artificial
  MsCOMT deletion introduced by TALEN pair MsCOMT_T02.1
tctcacaaaaacttcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10731 - DNA, 351 bp, Artificial
  MsCOMT deletion introduced by TALEN pair MsCOMT_T02.1
tctcacaaaaactctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 10732 - DNA, 361 bp, Artificial
  MsCOMT deletion introduced by TALEN pair MsCOMT_T02.1
tctcacaaaaactcctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10733 - DNA, 358 bp, Artificial
  MsCOMT deletion introduced by TALEN pair MsCOMT_T02.1
tctcacaaaaactcctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10734 - DNA, 352 bp, Artificial
  MsCOMT deletion introduced by TALEN pair MsCOMT_T02.1
tctcacaaaaactcatcaatcacaaccatgggttcaacaggtgaaactcaaatcacaccaacccacatatcagatgaagaagcaaacctcttcgccatgcaattagcaagtgcttcagttcttcccatgattttgaaatcagctcttgaacttgatctcttagaaatcaacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10735 - DNA, 361 bp, Artificial
  MsCOMT deletion introduced by TALEN pair MsCOMT_T02.1
tctcacaaaaactcatcaatcacaaccatgggttcaacaggtgaaactcaaatcacaccaacccacatatcagatgaagaagcaaacctcttcgccatgcaattagcaagtgcttcagttcttcccatgattttaaaatcatctcttgaacttgatctcttagaaatgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10736 - DNA, 359 bp, Artificial
  MsCOMT deletion introduced by TALEN pair MsCOMT_T02.1
tctcacaaaaactcatcaatcacaaccatgggttcaacaggtgaaactcaaatcacaccaacccacatatcagatgaagaagcaaacctcttcgccatgcaattagcaagtgcttcagttcttcccatgattttaaaatcagctcttgaacttgatctcttagaaatcatagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 10737 - DNA, 357 bp, Artificial
  MsCOMT deletion introduced by TALEN pair MsCOMT_T02.1
tctcacaaaaactcatcaatcacaaccatgggttcaacaggtgaaactcaaatcacaccaacccacatatcagatgaagaagcaaacctcttcgccatgcaattagcaagtgcttcagttcttcccatgattttaaaatcagctcttgaacttgatctcttagaaatcagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10738 - DNA, 309 bp, Artificial
  MsCOMT deletion introduced by TALEN pair MsCOMT_T02.1
tctcacaaaaactcatcaatcacaaccatgggttcaacaggtgaaactcaaatcacaccaacccacatatcagatgaagaagcaaacctcttcgccatgcaactagcaagtgcttcagttcttcccatgattttgaaatcagctcttgaacttgatctcttagaaattaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10739 - DNA, 358 bp, Artificial
  MsCOMT deletion introduced by TALEN pair MsCOMT_T02.1
tctcacaaaaactcatcaatcacaaccatgggttcaacaggtgaaactcaaatcacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10740 - DNA, 354 bp, Artificial
  MsCOMT deletion introduced by TALEN pair MsCOMT_T02.1
tctcacaaaaactcatcaatcacaaccatgggttcaacaggtgaaactcaaatcacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtattcaacaagatggaaaggttcagagactttatggtttggctactgttgctaa

SEQ ID NO: 10741 - DNA, 358 bp, Artificial
  MsCOMT deletion introduced by TALEN pair MsCOMT_T02.1
tctcacaaaaactcatcaatcacaaccatgggttcaacaggtgaaactcaaatcacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 10742 - DNA, 359 bp, Artificial
  MsCOMT deletion introduced by TALEN pair MsCOMT_T02.1
tctcacaaaaactcatcaatcacaaccatgggttcaacaggtgaaactcaaatcacaccaacccacatatcagatgaagaagcaaacctcttcgccatgcaactagcaagtgcttcagttcttcccatgattttaaaatcagctcttgaacttgatctcttagaaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10743 - DNA, 360 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccattcaattggcaagtgcttcagttcttcccatgattttaaaatcagctcttgaacttgatctctagaaatcataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10744 - DNA, 358 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccattcaattagcaagtgcttcagttcttcccatgattttaaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10745 - DNA, 352 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccattcaactagcaagtgcttcagttcttcccatgattttgaaatcagctcttgaacttgatttcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10746 - DNA, 356 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttagaaatcactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10747 - DNA, 353 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatcttgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10748 - DNA, 360 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10749 - DNA, 353 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10750 - DNA, 360 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10751 - DNA, 360 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10752 - DNA, 352 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcgacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10753 - DNA, 363 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcatgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgtgctaa

SEQ ID NO: 10754 - DNA, 362 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcactaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10755 - DNA, 358 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10756 - DNA, 358 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10757 - DNA, 350 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10758 - DNA, 353 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctaccaacaactaaccctgatgcaccagttatgttggaccgaatgttgcgtctcttggcttgatacaatatcctcacttgttcagttcgtactcaacaagatggaaaggttcagagactttatggtttggctactgttgctaa

SEQ ID NO: 10759 - DNA, 358 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10760 - DNA, 359 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10761 - DNA, 359 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtacgcaacaagatggaaaggttcagagcctttatggtttggctactgttgctaa

SEQ ID NO: 10762 - DNA, 361 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10763 - DNA, 356 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10764 - DNA, 354 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttctaa

SEQ ID NO: 10765 - DNA, 361 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10766 - DNA, 418 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgccgtgggcctggcacagcaccggcaacagcgcctgcaccgtctccagcgcttgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10767 - DNA, 362 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10768 - DNA, 359 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 10769 - DNA, 361 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10770 - DNA, 361 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10771 - DNA, 357 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10772 - DNA, 358 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10773 - DNA, 356 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10774 - DNA, 356 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10775 - DNA, 358 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttgtaccgaatgttgcgtctcttggcttgttacaatatcctcacttgttctgttcgtactcaacaagatggaaaggttcagagactttatggtttggctactgttgctaa

SEQ ID NO: 10776 - DNA, 358 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10777 - DNA, 358 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10778 - DNA, 354 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10779 - DNA, 354 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10780 - DNA, 355 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10781 - DNA, 356 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10782 - DNA, 353 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaattagcaagtgcttcagttcttcccatgatttaaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10783 - DNA, 259 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaattagcaagtgcttcagttcttcccataaccctgatgcaccagttatgttggaccgaatgttgcgtctcttgacttgttacaatatcctcacttgttcagttcgtactcaacaagatggaaaggttcagagactttatggtttggctactgttgctaa

SEQ ID NO: 10784 - DNA, 359 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaactagcaattgcttcagttcttcccatgattttgaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10785 - DNA, 353 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatcttgctaaagctggacctggtgctcaaatttcacctattgaagttgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 10786 - DNA, 343 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10787 - DNA, 350 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagttggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10788 - DNA, 350 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10789 - DNA, 357 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 10790 - DNA, 359 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaacataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10791 - DNA, 360 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10792 - DNA, 362 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttttggtttggctactgttgctaa

SEQ ID NO: 10793 - DNA, 355 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10794 - DNA, 359 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10795 - DNA, 354 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10796 - DNA, 360 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 10797 - DNA, 360 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10798 - DNA, 360 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10799 - DNA, 359 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatccaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10800 - DNA, 431 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatttacgccaacggttgaagtgccgatttgcggtcacgcgacagtagctgcgcactatgtacgtgcgaaggtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10801 - DNA, 356 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10802 - DNA, 360 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10803 - DNA, 357 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10804 - DNA, 356 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcactggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 10805 - DNA, 358 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10806 - DNA, 359 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10807 - DNA, 360 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10808 - DNA, 356 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10809 - DNA, 357 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 10810 - DNA, 358 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10811 - DNA, 354 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10812 - DNA, 355 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10813 - DNA, 356 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10814 - DNA, 355 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10815 - DNA, 352 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10816 - DNA, 349 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10817 - DNA, 345 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10818 - DNA, 305 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttgaaatcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10819 - DNA, 346 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10820 - DNA, 356 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10821 - DNA, 351 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10822 - DNA, 359 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10823 - DNA, 359 bp, Artificial
  MsCOMT deletion introduced by TALEN pair MsCOMT_T02.1
tctcacaaaaactcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10824 - DNA, 359 bp, Artificial
  MsCOMT deletion introduced by TALEN pair MsCOMT_T02.1
tctcacaaaaactcataatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatataaagctggacctggtactcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10825 - DNA, 354 bp, Artificial
  MsCOMT deletion introduced by TALEN pair MsCOMT_T02.1
tctcacaaaaactcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttaagttcgtactcaacaagatggaaaggttcagagacttatggtttggctactgttgctaa

SEQ ID NO: 10826 - DNA, 358 bp, Artificial
  MsCOMT deletion introduced by TALEN pair MsCOMT_T02.1
tctcacaaaaaccttcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10827 - DNA, 359 bp, Artificial
  MsCOMT deletion introduced by TALEN pair MsCOMT_T02.1
tctcacaaaaaccttcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10828 - DNA, 356 bp, Artificial
  MsCOMT deletion introduced by TALEN pair MsCOMT_T02.1
tctcacaaaaaccttcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10829 - DNA, 358 bp, Artificial
  MsCOMT deletion introduced by TALEN pair MsCOMT_T02.1
tctcacaaaaaccttcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaataaagctggaccttgtgctcaaatttcacctattgaaattgcttctcatctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10830 - DNA, 359 bp, Artificial
  MsCOMT deletion introduced by TALEN pair MsCOMT_T02.1
tctcacaaaaaccttatcaatcacaaccatgggttcaacaggtgaaactcaaataacaccaagccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtttcttggcttgttacaatatcctcgcttgttcagttcgtactcaacaagatggaaagtttcagagtctttatggtttggctactggtgctaa

SEQ ID NO: 10831 - DNA, 356 bp, Artificial
  MsCOMT deletion introduced by TALEN pair MsCOMT_T02.1
tctcacaaaaaccttatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctgttgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10832 - DNA, 357 bp, Artificial
  MsCOMT deletion introduced by TALEN pair MsCOMT_T02.1
tctcacaaaaaccttatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10833 - DNA, 360 bp, Artificial
  MsCOMT deletion introduced by TALEN pair MsCOMT_T02.1
tctcacaaaaaccttatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10834 - DNA, 359 bp, Artificial
  MsCOMT deletion introduced by TALEN pair MsCOMT_T02.1
tctcacaaaaaccttatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10835 - DNA, 356 bp, Artificial
  MsCOMT deletion introduced by TALEN pair MsCOMT_T02.1
tctcacaaaaaccttatcaatcacaaccatgggttcaacagatgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10836 - DNA, 359 bp, Artificial
  MsCOMT deletion introduced by TALEN pair MsCOMT_T02.1
tctcacaaaaacctcttcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10837 - DNA, 351 bp, Artificial
  MsCOMT deletion introduced by TALEN pair MsCOMT_T02.1
tctcacaaaaacctctcatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatttcttaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 10838 - DNA, 359 bp, Artificial
  MsCOMT deletion introduced by TALEN pair MsCOMT_T02.1
tctcacaaaaacctctcaatcacaaccattggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10839 - DNA, 358 bp, Artificial
  MsCOMT deletion introduced by TALEN pair MsCOMT_T02.1
tctcacaaaaacctctcaatcacaaccatgggttcaacaggtgaaactccaatcacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10840 - DNA, 360 bp, Artificial
  MsCOMT deletion introduced by TALEN pair MsCOMT_T02.1
tctcacaaaaacctctcaatcacaaccatgggttcaacaggtgaaactcaaatcacaccaacccacatatcagatgaagaagcaaacctcttcgccattcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10841 - DNA, 341 bp, Artificial
  MsCOMT deletion introduced by TALEN pair MsCOMT_T02.1
tctcacaaaaacctctcaatcacaaccatgggttcaacaggtgaaactcaaatcacaccaacccacatatcagatgaagaagcaaacctcttcgccatgcaattagcaagtgcttcagttcttcccatgattttgaaatcagctcttgaacttgatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10842 - DNA, 357 bp, Artificial
  MsCOMT deletion introduced by TALEN pair MsCOMT_T02.1
tctcacaaaaacctctcaatcacaaccatgggttcaacaggtgaaactcaaatcacaccaacccacatatcagatgaagaagcaaacctcttcgccatgcaattagcaagtgcttcagttcttcccatgattttgaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttgctactgttgctaa

SEQ ID NO: 10843 - DNA, 360 bp, Artificial
  MsCOMT deletion introduced by TALEN pair MsCOMT_T02.1
tctcacaaaaacctctcaatcacaaccatgggttcaacaggtgaaactcaaatcacaccaacccacatatcagatgaagaagcaaacctcttcgccatgcaattagcaagtgcttcagttcttcccatgattttaaaatcagctcttgaacttgatctcttagaaatcaaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 10844 - DNA, 359 bp, Artificial
  MsCOMT deletion introduced by TALEN pair MsCOMT_T02.1
tctcacaaaaacctctcaatcacaaccatgggttcaacaggtgaaactcaaatcacaccaacccacatatcagatgaagaagcaaacctcttcgccatgcaattagcaagtgcttcagttcttcccatgattttaaaatcagctcttgaacttgatctcttagaaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10845 - DNA, 351 bp, Artificial
  MsCOMT deletion introduced by TALEN pair MsCOMT_T02.1
tctcacaaaaacctctcaatcacaaccatgggttcaacaggtgaaactcaaatcacaccaacccacatatcagatgaagaagcaaacctcttcgccatgcaattagcaagtgcttcagttcttcccatgattttaaaatcagctcttgaacttgatctctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10846 - DNA, 358 bp, Artificial
  MsCOMT deletion introduced by TALEN pair MsCOMT_T02.1
tctcacaaaaacctctcaatcacaaccatgggttcaacaggtgaaactcaaatcacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10847 - DNA, 355 bp, Artificial
  MsCOMT deletion introduced by TALEN pair MsCOMT_T02.1
tctcacaaaaacctctcaatcacaaccatgggttcaacaggtgaaactcaaatcacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10848 - DNA, 350 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccattcaattagcaagtgcttcagttcttcccatgattttgaaatcagctcttgaacttgatctcttagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10849 - DNA, 359 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccattcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10850 - DNA, 357 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttagactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10851 - DNA, 352 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttagaactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10852 - DNA, 360 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10853 - DNA, 354 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10854 - DNA, 359 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccattcaactagcaagtgcttcagttcttcccatgattttgaaatcagcgcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10855 - DNA, 359 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10856 - DNA, 360 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10857 - DNA, 358 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10858 - DNA, 358 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10859 - DNA, 343 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaattagcaagtgcttcagttcttcccatgattttgaaatcagctcttgaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10860 - DNA, 345 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaattagcaagtgcttcagttcttcccatgattttaaaatcatctcttgaacttgatctctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 10861 - DNA, 350 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10862 - DNA, 350 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10863 - DNA, 352 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10864 - DNA, 359 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10865 - DNA, 359 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10866 - DNA, 360 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10867 - DNA, 360 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10868 - DNA, 450 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcggccgacgggcaggttgtagccgccggagtaggccttggtgtccacgatcacgccgtagtcgatgggggagcccacggtgtagatggcgccgtcgggcttcctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10869 - DNA, 356 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10870 - DNA, 355 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10871 - DNA, 356 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10872 - DNA, 355 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10873 - DNA, 358 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10874 - DNA, 359 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10875 - DNA, 359 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 10876 - DNA, 358 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10877 - DNA, 358 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10878 - DNA, 358 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10879 - DNA, 358 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10880 - DNA, 354 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10881 - DNA, 354 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10882 - DNA, 359 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 10883 - DNA, 355 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10884 - DNA, 352 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10885 - DNA, 351 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10886 - DNA, 351 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10887 - DNA, 341 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10888 - DNA, 356 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10889 - DNA, 351 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10890 - DNA, 357 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10891 - DNA, 358 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10892 - DNA, 360 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatttaaagctggacctggtgctcaaatttcacctattgaaattgcttctcagctaccaacaactaaccctgatgcaccagttatgttggaccgaatgttgcgtctcttggctggttacaatatcctcacttgttcagttcgtactcaacaagatggaaagattcagagactttatggtttggctactgttgctaa

SEQ ID NO: 10893 - DNA, 359 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10894 - DNA, 359 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10895 - DNA, 361 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10896 - DNA, 354 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 10897 - DNA, 354 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10898 - DNA, 360 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10899 - DNA, 360 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10900 - DNA, 360 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10901 - DNA, 360 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10902 - DNA, 360 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 10903 - DNA, 360 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtactcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10904 - DNA, 346 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcgtgctcaaatttcacctattgaaattgcttctcagctaccaacaactaaccctgatgcaccagttatgttggaccgaatgttgcgtctcttggcttgttacaatatcctcacttgttcagttcgttctcaacaagatggaaaggttcagagactttatggtttggctactgttgctaa

SEQ ID NO: 10905 - DNA, 353 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcagacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10906 - DNA, 358 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10907 - DNA, 246 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatacaatatcctcacttgttcagttcgtactcaacaagatggaaaagttcagagactttatggtttggctactgttgctaa

SEQ ID NO: 10908 - DNA, 358 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10909 - DNA, 359 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10910 - DNA, 355 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10911 - DNA, 352 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10912 - DNA, 352 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10913 - DNA, 356 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10914 - DNA, 354 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10915 - DNA, 352 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10916 - DNA, 345 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10917 - DNA, 358 bp, Artificial
  MsCOMT deletion introduced by TALEN pair MsCOMT_T02.1
tctcacaaaaacctctcaatcacaaccatgggttcaacaggtgaaactcaaataacaccaacccacatatcagatgaagaagcaaacctcttcgccatgcaactagcaagtgcatcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10918 - DNA, 197 bp, Artificial
  MsCOMT deletion introduced by TALEN pair MsCOMT_T02.1
tctcacaaaaacctctcaatcacaaccatgggttcaacaggtgaaactcaaataacaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10919 - DNA, 357 bp, Artificial
  MsCOMT deletion introduced by TALEN pair MsCOMT_T02.1
tctcacaaaaacctctaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10920 - DNA, 360 bp, Artificial
  MsCOMT deletion introduced by TALEN pair MsCOMT_T02.1
tctcacaaaaacctcgtcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattaaagctggacctggtactcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10921 - DNA, 353 bp, Artificial
  MsCOMT deletion introduced by TALEN pair MsCOMT_T02.1
tctcacaaaaacctcgtcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttaaagctggacctggtgctcaaatttcacctattgaaattgcttctcagctaccaacaactaaccctgatgcaccagttatgttggaccgaatgttgcgtctcttggtttgttacaatatcctcacttgttctgttcgtactcaacaagatggaaaggttcagagactttatggtttggctactgttgctaa

SEQ ID NO: 10922 - DNA, 358 bp, Artificial
  MsCOMT deletion introduced by TALEN pair MsCOMT_T02.1
tctcacaaaaacctcgtcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10923 - DNA, 346 bp, Artificial
  MsCOMT deletion introduced by TALEN pair MsCOMT_T02.1
tctcacaaaaacctcgtcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatcgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10924 - DNA, 357 bp, Artificial
  MsCOMT deletion introduced by TALEN pair MsCOMT_T02.1
tctcacaaaaacctcctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagataaagctggacctggtgctcaaatttcacctattgaaattgcttctcagctaccaacaactaaccctgatgcaccagttatgttggaccgaatgttgcgtctctttgcttgttacaatatcctcacttgttcagttcgtactcaacaagatggaaaagttcagagactttatggtttggctactgttgctaa

SEQ ID NO: 10925 - DNA, 361 bp, Artificial
  MsCOMT deletion introduced by TALEN pair MsCOMT_T02.1
tctcacaaaaacctcctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaaagctggacctggtgctcaaatttcacctattgaaattgcttctcagctaccaacagctaaccctgatgcaccagttatgttggaccgaatgttgcgtctcttggcttgttacaatatcctcacttgttcagttcgttctcaacaagatggaaaggttcagagactttatggtttggctacggttgctaa

SEQ ID NO: 10926 - DNA, 352 bp, Artificial
  MsCOMT deletion introduced by TALEN pair MsCOMT_T02.1
tctcacaaaaacctcctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10927 - DNA, 353 bp, Artificial
  MsCOMT deletion introduced by TALEN pair MsCOMT_T02.1
tctcacaaaaacctccaatcacaaccatgggttcaacaggtgaaactcaaataccaccaacccacatatcagatgaagaagcaaacctcttcgccatgcaactagcaagtgcttcagttcttcccatgattttgaaatcagctcttgaacttgatctcttctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 10928 - DNA, 318 bp, Artificial
  MsCOMT deletion introduced by TALEN pair MsCOMT_T02.1
tctcacaaaaacctccaatcacaaccatgggttcaacaggtgaaactcaaataacaccaacccacatatcagatgaagaagcaaacctcttcgccatgcaattagcaagtgcttcagttcttcccatgattttaaaatcagctcttgaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 10929 - DNA, 360 bp, Artificial
  MsCOMT deletion introduced by TALEN pair MsCOMT_T02.1
tctcacaaaaacctcattcaatcacaaccatgggttcaacaggtgaaactcaactaacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10930 - DNA, 362 bp, Artificial
  MsCOMT deletion introduced by TALEN pair MsCOMT_T02.1
tctcacaaaaacctcattcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10931 - DNA, 364 bp, Artificial
  MsCOMT deletion introduced by TALEN pair MsCOMT_T02.1
tctcacaaaaacctcattcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10932 - DNA, 358 bp, Artificial
  MsCOMT deletion introduced by TALEN pair MsCOMT_T02.1
tctcacaaaaacctcattaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttaggctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 10933 - DNA, 359 bp, Artificial
  MsCOMT deletion introduced by TALEN pair MsCOMT_T02.1
tctcacaaaaacctcattaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10934 - DNA, 360 bp, Artificial
  MsCOMT deletion introduced by TALEN pair MsCOMT_T02.1
tctcacaaaaacctcattaatcacaaacatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10935 - DNA, 360 bp, Artificial
  MsCOMT deletion introduced by TALEN pair MsCOMT_T02.1
tctcacaaaaacctcatctatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10936 - DNA, 346 bp, Artificial
  MsCOMT deletion introduced by TALEN pair MsCOMT_T02.1
tctcacaaaaacctcatctatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10937 - DNA, 361 bp, Artificial
  MsCOMT deletion introduced by TALEN pair MsCOMT_T02.1
tctcacaaaaacctcatcgatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10938 - DNA, 353 bp, Artificial
  MsCOMT deletion introduced by TALEN pair MsCOMT_T02.1
tctcacaaaaacctcatcgatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10939 - DNA, 361 bp, Artificial
  MsCOMT deletion introduced by TALEN pair MsCOMT_T02.1
tctcacaaaaacctcatcgatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10940 - DNA, 348 bp, Artificial
  MsCOMT deletion introduced by TALEN pair MsCOMT_T02.1
tctcacaaaaacctcatcgatcacaaccatgggttcaacaggtgaaactcaaataacaccaacccacatatcagatgaagaagcaaacctcttcgccatgcaactagcaagtgcttcagttcttcccatgattttgaaatcagctcttgaacttgataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10941 - DNA, 350 bp, Artificial
  MsCOMT deletion introduced by TALEN pair MsCOMT_T02.1
tctcacaaaaacctcatcgatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10942 - DNA, 359 bp, Artificial
  MsCOMT deletion introduced by TALEN pair MsCOMT_T02.1
tctcacaaaaacctcatcgatcacaaccatgggttcaacaggtgaaactcaaataacaccaacccacatataagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgtttgaccgaatgttgcgtctcttggcttgttacaatatcctcacttgttcagttcgtactcaacaagatggaaaggttcagagactttatggtttggctactgtttctaa

SEQ ID NO: 10943 - DNA, 357 bp, Artificial
  MsCOMT deletion introduced by TALEN pair MsCOMT_T02.1
tctcacaaaaacctcatccatcacaaccatgggttcaacaggtgaaactcaataacaccaacccacatatcagatgaagaagcaaacctcttcgccatgcaattagcaagtgcttcagttcttcccatgattttaaaatcacctcttgaacttgatctcttaggctaaagctggacctggtgctcaaatttcacctgttcaaattgcttctcagcttccaacaactaaccctgatgcaccagtcctgttggaccgaatgttgcctctcttggcttgttacaatatcctcccttgttcagttcgtactcaacaagatggaaaggttcagagactttatggtttggctactgttgctaa

SEQ ID NO: 10944 - DNA, 361 bp, Artificial
  MsCOMT deletion introduced by TALEN pair MsCOMT_T02.1
tctcacaaaaacctcatcattcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10945 - DNA, 359 bp, Artificial
  MsCOMT deletion introduced by TALEN pair MsCOMT_T02.1
tctcacaaaaacctcatcattcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 10946 - DNA, 359 bp, Artificial
  MsCOMT deletion introduced by TALEN pair MsCOMT_T02.1
tctcacaaaaacctcatcattcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10947 - DNA, 360 bp, Artificial
  MsCOMT deletion introduced by TALEN pair MsCOMT_T02.1
tctcacaaaaacctcatcattcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10948 - DNA, 354 bp, Artificial
  MsCOMT deletion introduced by TALEN pair MsCOMT_T02.1
tctcacaaaaacctcatcatcacaaccattggttcaacaggtgaaactcaaataacaccaacccacatatcagatgaagaagcaaacctcttcgccattcaattagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10949 - DNA, 360 bp, Artificial
  MsCOMT deletion introduced by TALEN pair MsCOMT_T02.1
tctcacaaaaacctcatcatcacaaccattggttcaacaggtgaaactcaaataacaccaacccacatatcagatgaagaagcaaacctcttcgccattcaactagcaagtgcttcagttcttcccatgattttgaaatcagctcttgaacttgatctcttagaaagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10950 - DNA, 352 bp, Artificial
  MsCOMT deletion introduced by TALEN pair MsCOMT_T02.1
tctcacaaaaacctcatcatcacaaccattggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10951 - DNA, 360 bp, Artificial
  MsCOMT deletion introduced by TALEN pair MsCOMT_T02.1
tctcacaaaaacctcatcatcacaaccatgggttcaacaggtgaaactccaataacaccaacccacatatcagatgaagaagaaaacctcttcgccatgcaattatcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10952 - DNA, 353 bp, Artificial
  MsCOMT deletion introduced by TALEN pair MsCOMT_T02.1
tctcacaaaaacctcatcatcacaaccatgggttcaacaggtgaaactcaaatcacaccaacccacatatcagatgaagaagcaaacctcttcgccattcaactagcaagtgcttcagttcttcccatgattttgaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10953 - DNA, 356 bp, Artificial
  MsCOMT deletion introduced by TALEN pair MsCOMT_T02.1
tctcacaaaaacctcatcatcacaaccatgggttcaacaggtgaaactcaaatcacaccaacccacatatcagatgaagaagcaaacctcttcgccatgcaactagcaagtgcttcagttcttcccatgattttgaaatcagctcttgaacttgatctcttagaaatcactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10954 - DNA, 356 bp, Artificial
  MsCOMT deletion introduced by TALEN pair MsCOMT_T02.1
tctcacaaaaacctcatcatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 10955 - DNA, 352 bp, Artificial
  MsCOMT deletion introduced by TALEN pair MsCOMT_T02.1
tctcacaaaaacctcatcatcacaaccatgggttcaacaggtgaaactcaaataacaccaacccacatatcagatgaagaagcaaacctcttcgccatgcaattagcaagtgcttcagttcttcccatgattttaaaatcatctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10956 - DNA, 357 bp, Artificial
  MsCOMT deletion introduced by TALEN pair MsCOMT_T02.1
tctcacaaaaacctcatcatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10957 - DNA, 359 bp, Artificial
  MsCOMT deletion introduced by TALEN pair MsCOMT_T02.1
tctcacaaaaacctcatcatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttgaaccgaatgttgcgtctcttggcttgttacaatatcctcacttgttcagttcgtactcaacaagatggaaagattcagagactttatggtttggctactgttgctaa

SEQ ID NO: 10958 - DNA, 358 bp, Artificial
  MsCOMT deletion introduced by TALEN pair MsCOMT_T02.1
tctcacaaaaacctcatcatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10959 - DNA, 354 bp, Artificial
  MsCOMT deletion introduced by TALEN pair MsCOMT_T02.1
tctcacaaaaacctcatcatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10960 - DNA, 358 bp, Artificial
  MsCOMT deletion introduced by TALEN pair MsCOMT_T02.1
tctcacaaaaacctcatcatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10961 - DNA, 354 bp, Artificial
  MsCOMT deletion introduced by TALEN pair MsCOMT_T02.1
tctcacaaaaacctcatcatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10962 - DNA, 354 bp, Artificial
  MsCOMT deletion introduced by TALEN pair MsCOMT_T02.1
tctcacaaaaacctcatcatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10963 - DNA, 354 bp, Artificial
  MsCOMT deletion introduced by TALEN pair MsCOMT_T02.1
tctcacaaaaacctcatcatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10964 - DNA, 322 bp, Artificial
  MsCOMT deletion introduced by TALEN pair MsCOMT_T02.1
tctcacaaaaacctcatcatcacaaccatgggttcaacaggtgaaactcaaataacaccaacccacatatcagatgaagaagcaaacctcttcgccatgcaactagcaagtgcttcagttcttcccatgataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10965 - DNA, 354 bp, Artificial
  MsCOMT deletion introduced by TALEN pair MsCOMT_T02.1
tctcacaaaaacctcatcatcacaaccatgggttcaacaggtgaaactcaaataacaccaacccacatatcagaagaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagtttcagagactttatggtttggctactgttgctaa

SEQ ID NO: 10966 - DNA, 358 bp, Artificial
  MsCOMT deletion introduced by TALEN pair MsCOMT_T02.1
tctcacaaaaacctcatcatcacaacaatgggttcaacaggcgaaactcaaataacaccaacccacacatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacagtatcctcacttgtgcagttcgtactcaacaatatggaaaggttcagagactgtatggtttggctactgttgctaa

SEQ ID NO: 10967 - DNA, 422 bp, Artificial
  MsCOMT deletion introduced by TALEN pair MsCOMT_T02.1
tctcacaaaaacctcatcagtcacaaccatgggttcaacaggtgaaactcaaataacaccaacccacatatcagatgaagaagtaaacctcttcgccatgcaactagcaagtgcttcagttcttcccatgattttaaaatcagctcttgaacttgatctcttagaaagcaagcaggcgctggagacggtccagcggctgttgccggtgctgtgccaggcccacggcttgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10968 - DNA, 354 bp, Artificial
  MsCOMT deletion introduced by TALEN pair MsCOMT_T02.1
tctcacaaaaacctcatcagtcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 10969 - DNA, 362 bp, Artificial
  MsCOMT deletion introduced by TALEN pair MsCOMT_T02.1
tctcacaaaaacctcatcagtcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10970 - DNA, 360 bp, Artificial
  MsCOMT deletion introduced by TALEN pair MsCOMT_T02.1
tctcacaaaaacctcatcagtcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10971 - DNA, 358 bp, Artificial
  MsCOMT deletion introduced by TALEN pair MsCOMT_T02.1
tctcacaaaaacctcatcactcacaaccatgggttcaacaggtgaaactcaaataaccccaacccacatatcagatgaagaagcaaacctcttcgccatgcaattagcaagtgcttcagttcttcccatgattttgaaatcagctcttgaacttgatctcttatactaaagctggacctggtgctcaaatttcaccatatcaaattgcttcacagcttccaacatctaaccctgatgcaccagttatgttggactgaatgttacgtctctgggcttgttacaatatcctcacttgtgctgttcgtactcaacaagatggaaaggttcagagactttatggtttggctactggtgctaa

SEQ ID NO: 10972 - DNA, 357 bp, Artificial
  MsCOMT deletion introduced by TALEN pair MsCOMT_T02.1
tctcacaaaaacctcatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 10973 - DNA, 359 bp, Artificial
  MsCOMT deletion introduced by TALEN pair MsCOMT_T02.1
tctcacaaaaacctcatcaattacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaagtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10974 - DNA, 360 bp, Artificial
  MsCOMT deletion introduced by TALEN pair MsCOMT_T02.1
tctcacaaaaacctcatcaattacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 10975 - DNA, 357 bp, Artificial
  MsCOMT deletion introduced by TALEN pair MsCOMT_T02.1
tctcacaaaaacctcatcaattacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 10976 - DNA, 354 bp, Artificial
  MsCOMT deletion introduced by TALEN pair MsCOMT_T02.1
tctcacaaaaacctcatcaatctcaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaagctggacctggtgctcaaatttcacctattgaaattgcttctcagctaccaacaactagccctgatgcaccagttatgttggaccgaatgttgcgtcgcttggcttgttacaatatcctcacttgttctgttcgtactcaacaagatggaaagattcagagactttagggtttggctactgatgctaa

SEQ ID NO: 10977 - DNA, 358 bp, Artificial
  MsCOMT deletion introduced by TALEN pair MsCOMT_T02.1
tctcacaaaaacctcatcaatctcaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 10978 - DNA, 419 bp, Artificial
  MsCOMT deletion introduced by TALEN pair MsCOMT_T02.1
tctcacaaaaacctcatcaatctcaaccatgggttcaacaggtgaaactcaaataacaccaacccacatatcagatgaagaagcaaacctcttcgccatgcaactagcaagtgcttcagttcttcccatgattttgaaatcagctcttgaacttgatctcggcttgaccccggagcaggtggtggccatcgccagcaatattggcggcaagcaggcgctggagacggtgcagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10979 - DNA, 358 bp, Artificial
  MsCOMT deletion introduced by TALEN pair MsCOMT_T02.1
tctcacaaaaacctcatcaatctcaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10980 - DNA, 360 bp, Artificial
  MsCOMT deletion introduced by TALEN pair MsCOMT_T02.1
tctcacaaaaacctcatcaatcgcaaccatgggttcaccaggtgaaactcaaataacaccaacccacatatcagatgaagaagcaaacctcttcgccatgcaactagcaagtgcttcagttcttcccatgattttgaaatcagctcttgaacttgatctcttagaaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10981 - DNA, 355 bp, Artificial
  MsCOMT deletion introduced by TALEN pair MsCOMT_T02.1
tctcacaaaaacctcatcaatcgcaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10982 - DNA, 356 bp, Artificial
  MsCOMT deletion introduced by TALEN pair MsCOMT_T02.1
tctcacaaaaacctcatcaatcgcaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10983 - DNA, 351 bp, Artificial
  MsCOMT deletion introduced by TALEN pair MsCOMT_T02.1
tctcacaaaaacctcatcaatcgcaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10984 - DNA, 358 bp, Artificial
  MsCOMT deletion introduced by TALEN pair MsCOMT_T02.1
tctcacaaaaacctcatcaatcccaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10985 - DNA, 360 bp, Artificial
  MsCOMT deletion introduced by TALEN pair MsCOMT_T02.1
tctcacaaaaacctcatcaatcataaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10986 - DNA, 347 bp, Artificial
  MsCOMT deletion introduced by TALEN pair MsCOMT_T02.1
tctcacaaaaacctcatcaatcataaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10987 - DNA, 361 bp, Artificial
  MsCOMT deletion introduced by TALEN pair MsCOMT_T02.1
tctcacaaaaacctcatcaatcataaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10988 - DNA, 361 bp, Artificial
  MsCOMT deletion introduced by TALEN pair MsCOMT_T02.1
tctcacaaaaacctcatcaatcataaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10989 - DNA, 295 bp, Artificial
  MsCOMT deletion introduced by TALEN pair MsCOMT_T02.1
tctcacaaaaacctcatcaatcataaccatgggttcaacaggtgaaactcaaataacaccaacccacatatcagatgaagaagcaaacctcttcgccatgcaactagcaagtgcttcagttcttcccatgattctgaaatcagctcttgaacctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 10990 - DNA, 292 bp, Artificial
  MsCOMT deletion introduced by TALEN pair MsCOMT_T02.1
tctcacaaaaacctcatcaatcataaccatgggttcaacaggtgaaactcaaataacaccaacccacatatcagatgaagaagcaaacctcttcgccatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10991 - DNA, 361 bp, Artificial
  MsCOMT deletion introduced by TALEN pair MsCOMT_T02.1
tctcacaaaaacctcatcaatcagaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10992 - DNA, 434 bp, Artificial
  MsCOMT deletion introduced by TALEN pair MsCOMT_T02.1
tctcacaaaaacctcatcaatcactaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctggtgctgtgccaggcccacggcttgaccccccagcaggtggtggccatcgccagcaatggcggtggctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10993 - DNA, 359 bp, Artificial
  MsCOMT deletion introduced by TALEN pair MsCOMT_T02.1
tctcacaaaaacctcatcaatcactaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10994 - DNA, 358 bp, Artificial
  MsCOMT deletion introduced by TALEN pair MsCOMT_T02.1
tctcacaaaaacctcatcaatcacgaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaatcatgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10995 - DNA, 354 bp, Artificial
  MsCOMT deletion introduced by TALEN pair MsCOMT_T02.1
tctcacaaaaacctcatcaatcacgaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10996 - DNA, 363 bp, Artificial
  MsCOMT deletion introduced by TALEN pair MsCOMT_T02.1
tctcacaaaaacctcatcaatcacgaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10997 - DNA, 355 bp, Artificial
  MsCOMT deletion introduced by TALEN pair MsCOMT_T02.1
tctcacaaaaacctcatcaatcacgaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 10998 - DNA, 361 bp, Artificial
  MsCOMT deletion introduced by TALEN pair MsCOMT_T02.1
tctcacaaaaacctcatcaatcacgaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 10999 - DNA, 358 bp, Artificial
  MsCOMT deletion introduced by TALEN pair MsCOMT_T02.1
tctcacaaaaacctcatcaatcacgaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11000 - DNA, 360 bp, Artificial
  MsCOMT deletion introduced by TALEN pair MsCOMT_T02.1
tctcacaaaaacctcatcaatcacgaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11001 - DNA, 359 bp, Artificial
  MsCOMT deletion introduced by TALEN pair MsCOMT_T02.1
tctcacaaaaacctcatcaatcacgaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 11002 - DNA, 359 bp, Artificial
  MsCOMT deletion introduced by TALEN pair MsCOMT_T02.1
tctcacaaaaacctcatcaatcacgaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11003 - DNA, 356 bp, Artificial
  MsCOMT deletion introduced by TALEN pair MsCOMT_T02.1
tctcacaaaaacctcatcaatcacgaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11004 - DNA, 358 bp, Artificial
  MsCOMT deletion introduced by TALEN pair MsCOMT_T02.1
tctcacaaaaacctcatcaatcacgaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11005 - DNA, 353 bp, Artificial
  MsCOMT deletion introduced by TALEN pair MsCOMT_T02.1
tctcacaaaaacctcatcaatcacgaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11006 - DNA, 360 bp, Artificial
  MsCOMT deletion introduced by TALEN pair MsCOMT_T02.1
tctcacaaaaacctcatcaatcacgaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11007 - DNA, 353 bp, Artificial
  MsCOMT deletion introduced by TALEN pair MsCOMT_T02.1
tctcacaaaaacctcatcaatcacgaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11008 - DNA, 361 bp, Artificial
  MsCOMT deletion introduced by TALEN pair MsCOMT_T02.1
tctcacaaaaacctcatcaatcacgaccatgggttcaacaggtgaaactcaaataacaccaacccacatatcagatgaagaaacaaacctcttcgccatgcaactagcaagtgcttcagttcttcccatgattttgaaatcagctcttgaacttgatctcttagaaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagatccagagactttatggtttggctactgttgctaa

SEQ ID NO: 11009 - DNA, 355 bp, Artificial
  MsCOMT deletion introduced by TALEN pair MsCOMT_T02.1
tctcacaaaaacctcatcaatcacccccatgggttcaacaggtgaaactcaaataaccccaacccccctctccgctgacgaagcaaacctcttcgccatgcaattagcaagtgcttcagttcttcccatgattttgaaatcagctcttgaacttgatctcttagaaatctggacctggtgctcccatttcacctattgaaattgcttctcagctccccccaactacccctgatgcaccagttatgttggaccgaatgttgcgtctcttggcttgttacaatatcctcacgggttcagttcgtactcaacaagatggaaagattccgagactttatggtttggctactgttgctaa

SEQ ID NO: 11010 - DNA, 346 bp, Artificial
  MsCOMT deletion introduced by TALEN pair MsCOMT_T02.1
tctcacaaaaacctcatcaatcacccccatgggttcaacaggtgaaactcaaataaccccaacccccctctccgctgacgaagcaaacctcttcgccatgcaattagcaagtgcttcagttcttcccatgattttaaaatcagctcttgaacttgatctctggacctgttgctcaaatttcacctattgaaattgcttctcagctaccaacaactcaccctgatgccccagttatgttggaccgaatgttgcgtctcttggcttgttacaatatcctgacgggttcagttcgtactcaacaagatggaaaggttcagagactttatggtttggctactgttgctaa

SEQ ID NO: 11011 - DNA, 360 bp, Artificial
  MsCOMT deletion introduced by TALEN pair MsCOMT_T02.1
tctcacaaaaacctcatcaatcaccaccatgggttcaacaggtgaaactcaaataacaccaacccacctatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11012 - DNA, 355 bp, Artificial
  MsCOMT deletion introduced by TALEN pair MsCOMT_T02.1
tctcacaaaaacctcatcaatcaccaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11013 - DNA, 353 bp, Artificial
  MsCOMT deletion introduced by TALEN pair MsCOMT_T02.1
tctcacaaaaacctcatcaatcaccaccatgggttcaacaggggaaactcaaataacaccaacccacatatcagctgaagaagcaaacctcttcgccatgaaactagcaagtgcttcagttcttccaatgattttgaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcactttttcagttcgtactcaacaagatggaaagattcagagactttatggtttggctactgttgctaa

SEQ ID NO: 11014 - DNA, 360 bp, Artificial
  MsCOMT deletion introduced by TALEN pair MsCOMT_T02.1
tctcacaaaaacctcatcaatcacatccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11015 - DNA, 359 bp, Artificial
  MsCOMT deletion introduced by TALEN pair MsCOMT_T02.1
tctcacaaaaacctcatcaatcacatccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11016 - DNA, 359 bp, Artificial
  MsCOMT deletion introduced by TALEN pair MsCOMT_T02.1
tctcacaaaaacctcatcaatcacatccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11017 - DNA, 360 bp, Artificial
  MsCOMT deletion introduced by TALEN pair MsCOMT_T02.1
tctcacaaaaacctcatcaatcacatccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11018 - DNA, 361 bp, Artificial
  MsCOMT deletion introduced by TALEN pair MsCOMT_T02.1
tctcacaaaaacctcatcaatcacatccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11019 - DNA, 351 bp, Artificial
  MsCOMT deletion introduced by TALEN pair MsCOMT_T02.1
tctcacaaaaacctcatcaatcacatccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11020 - DNA, 363 bp, Artificial
  MsCOMT deletion introduced by TALEN pair MsCOMT_T02.1
tctcacaaaaacctcatcaatcacatccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattaaagctggacctgttgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 11021 - DNA, 355 bp, Artificial
  MsCOMT deletion introduced by TALEN pair MsCOMT_T02.1
tctcacaaaaacctcatcaatcacatccatgggttcaacaggtgaaactcaaataacaccaacccacatatcagatgaagaagcaaacctcttcgccatgcaactagcaagggcttcagttcttcccatgattttgaaatcagctcttgaacttgatctcttagaaagctggacctggtgctcaaatttcacctattgaaattgcttctcagctcccaacaactaaccctgatgcaccagttatgttggaccgaattttgcgtctcttggcttgttacaatatcctcacttgttcagttcgtactcaacaagatggaaaggttcagagactttatggtttggctactgttgctaa

SEQ ID NO: 11022 - DNA, 351 bp, Artificial
  MsCOMT deletion introduced by TALEN pair MsCOMT_T02.1
tctcacaaaaacctcatcaatcacagccgtgggttcaacaggtgaaactcaactaacaccaacccacatatcagatgaagaagcaaacctcttcgcaatgcaactagcaagtgcttcatttcttcccatgattttaaaatcagctcttgcacttgatctcttagctggacctggtgctcaaatttcacctattgaaattgcttctcagctcacaacaactaaccctgatgcaccagttatgttggaccgaatgttgcgtctcttggcttgttacaatatcctaacttgttcagttcgtactcaacaagatggaaagattcagagactttatggtttggctactgttgcgaa

SEQ ID NO: 11023 - DNA, 320 bp, Artificial
  MsCOMT deletion introduced by TALEN pair MsCOMT_T02.1
tctcacaaaaacctcatcaatcacagccatgggttcaacaggtgaaactcaaataacaccaacccacatatcagatgaagaagcaaacctcttcgccatgcaattagcaagtgcttcagttcttcccatgattttaaaatcagctcttgaacttgatctcttgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11024 - DNA, 359 bp, Artificial
  MsCOMT deletion introduced by TALEN pair MsCOMT_T02.1
tctcacaaaaacctcatcaatcacagccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaattaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 11025 - DNA, 361 bp, Artificial
  MsCOMT deletion introduced by TALEN pair MsCOMT_T02.1
tctcacaaaaacctcatcaatcacagccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11026 - DNA, 362 bp, Artificial
  MsCOMT deletion introduced by TALEN pair MsCOMT_T02.1
tctcacaaaaacctcatcaatcacagccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11027 - DNA, 358 bp, Artificial
  MsCOMT deletion introduced by TALEN pair MsCOMT_T02.1
tctcacaaaaacctcatcaatcacagccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11028 - DNA, 358 bp, Artificial
  MsCOMT deletion introduced by TALEN pair MsCOMT_T02.1
tctcacaaaaacctcatcaatcacagccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11029 - DNA, 359 bp, Artificial
  MsCOMT deletion introduced by TALEN pair MsCOMT_T02.1
tctcacaaaaacctcatcaatcacagccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 11030 - DNA, 357 bp, Artificial
  MsCOMT deletion introduced by TALEN pair MsCOMT_T02.1
tctcacaaaaacctcatcaatcacagccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11031 - DNA, 352 bp, Artificial
  MsCOMT deletion introduced by TALEN pair MsCOMT_T02.1
tctcacaaaaacctcatcaatcacagccatgggttcaacaggtgaaactcaaataacaccaacccacatatcagatgaagaagcaaacctcttcgccatgcaattagcaagtgcttcagttcttcccatgattttaaaatcagctcttgaacttgatctcttaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 11032 - DNA, 342 bp, Artificial
  MsCOMT deletion introduced by TALEN pair MsCOMT_T02.1
tctcacaaaaacctcatcaatcacagccatgggttcaacaggtgaaactcaaataacaccaacccacatatcagatgaagaagcaaacctcttcgccatgcaattagcaagtgcttcagttcttcccatgattttaaaatcagctcttgaacttgatctacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11033 - DNA, 350 bp, Artificial
  MsCOMT deletion introduced by TALEN pair MsCOMT_T02.1
tctcacaaaaacctcatcaatcacagccatgggttcaacaggtgaaactcaaataacaccaacccacatatcagatgaagaagcaaacctcttcgccatgcaattagcaagtgcttcagttcttcccatgattttaaaatcagctcttgaacttgatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11034 - DNA, 345 bp, Artificial
  MsCOMT deletion introduced by TALEN pair MsCOMT_T02.1
tctcacaaaaacctcatcaatcacagccatgggttcaacaggtgaaactcaaataacaccaacccacatatcagatgaagaagcaaacctcttcgccatgcaattagcaagtgcttcagttcttcccatgattttaaaatcagctcttgaacttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11035 - DNA, 360 bp, Artificial
  MsCOMT deletion introduced by TALEN pair MsCOMT_T02.1
tctcacaaaaacctcatcaatcacagccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11036 - DNA, 355 bp, Artificial
  MsCOMT deletion introduced by TALEN pair MsCOMT_T02.1
tctcacaaaaacctcatcaatcacagccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11037 - DNA, 422 bp, Artificial
  MsCOMT deletion introduced by TALEN pair MsCOMT_T02.1
tctcacaaaaacctcatcaatcacagccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcacgggccagcggctgttgccggtgctgtgccaggcccacggcttgaccccccagcaggtggtaaagctggacctggagctcaaatttcacctattgaaattgcttctcagctcccaacaactaaccctgatgcaccagttatgttggaccgaatgttgcgtctcttggcttgttacaatatcctcacttgttcagttcgtgctcaacaagatggaaaggttcagagactttatggtttggctactgttgctaa

SEQ ID NO: 11038 - DNA, 359 bp, Artificial
  MsCOMT deletion introduced by TALEN pair MsCOMT_T02.1
tctcacaaaaacctcatcaatcacagccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11039 - DNA, 355 bp, Artificial
  MsCOMT deletion introduced by TALEN pair MsCOMT_T02.1
tctcacaaaaacctcatcaatcacagccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11040 - DNA, 356 bp, Artificial
  MsCOMT deletion introduced by TALEN pair MsCOMT_T02.1
tctcacaaaaacctcatcaatcacagccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtcctcaacaagatggaaaggttcagagactttatggtttggctactgttgctaa

SEQ ID NO: 11041 - DNA, 352 bp, Artificial
  MsCOMT deletion introduced by TALEN pair MsCOMT_T02.1
tctcacaaaaacctcatcaatcacagccatgggttcaacaggtgaaactcaaataacaccaacccacatatcagatgaagaagcaaacctcttcgccatgcaactagcaagtgcttcagttcttcccatgattttgaaatcagctcttgaacttgatctcttaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11042 - DNA, 344 bp, Artificial
  MsCOMT deletion introduced by TALEN pair MsCOMT_T02.1
tctcacaaaaacctcatcaatcacagccatgggttcaacaggtgaaactcaaataacaccaacccacatatcagatgaagaagcaaacctcttcgccatgcaactagcaagtgcttcagttcttcccatgattttaaaatcagctcttgaacttaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11043 - DNA, 198 bp, Artificial
  MsCOMT deletion introduced by TALEN pair MsCOMT_T02.1
tctcacaaaaacctcatcaatcacagccatgggttcaacaggtgaaactcaaataacaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11044 - DNA, 360 bp, Artificial
  MsCOMT deletion introduced by TALEN pair MsCOMT_T02.1
tctcacaaaaacctcatcaatcacacccatgggttcaacaggtgaaactcaaataacaccaacccacatatcagatgaagaagcaaacctcttcgccatgcaactagcaagtgcttcagctcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11045 - DNA, 352 bp, Artificial
  MsCOMT deletion introduced by TALEN pair MsCOMT_T02.1
tctcacaaaaacctcatcaatcacaccatgggttcaacaggtgaaactcaaatcacaccaacccacatatcagatgaagaagcaaacctcttcgccatgcaattaacaagtgcttcagttcttcccatgattttaaaatcagctcttgaacttgatttcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11046 - DNA, 360 bp, Artificial
  MsCOMT deletion introduced by TALEN pair MsCOMT_T02.1
tctcacaaaaacctcatcaatcacaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11047 - DNA, 357 bp, Artificial
  MsCOMT deletion introduced by TALEN pair MsCOMT_T02.1
tctcacaaaaacctcatcaatcacaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11048 - DNA, 353 bp, Artificial
  MsCOMT deletion introduced by TALEN pair MsCOMT_T02.1
tctcacaaaaacctcatcaatcacaccatgggttcaacaggtgaaactcaaataacaccaacccacatatcagatgaagaagcaaacctcttcgccatgcaactagcaagtgcttcagttcttcccatgattttgaaatcagctcttgaacttgatctcactaaagctggacctggtactcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11049 - DNA, 359 bp, Artificial
  MsCOMT deletion introduced by TALEN pair MsCOMT_T02.1
tctcacaaaaacctcatcaatcacaatcatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11050 - DNA, 354 bp, Artificial
  MsCOMT deletion introduced by TALEN pair MsCOMT_T02.1
tctcacaaaaacctcatcaatcacaatcatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11051 - DNA, 361 bp, Artificial
  MsCOMT deletion introduced by TALEN pair MsCOMT_T02.1
tctcacaaaaacctcatcaatcacaatcatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11052 - DNA, 359 bp, Artificial
  MsCOMT deletion introduced by TALEN pair MsCOMT_T02.1
tctcacaaaaacctcatcaatcacaactatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11053 - DNA, 357 bp, Artificial
  MsCOMT deletion introduced by TALEN pair MsCOMT_T02.1
tctcacaaaaacctcatcaatcacaactatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 11054 - DNA, 359 bp, Artificial
  MsCOMT deletion introduced by TALEN pair MsCOMT_T02.1
tctcacaaaaacctcatcaatcacaactatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatgtaaatgttcagagactttatggtttggctactgttgctaa

SEQ ID NO: 11055 - DNA, 356 bp, Artificial
  MsCOMT deletion introduced by TALEN pair MsCOMT_T02.1
tctcacaaaaacctcatcaatcacaactatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11056 - DNA, 357 bp, Artificial
  MsCOMT deletion introduced by TALEN pair MsCOMT_T02.1
tctcacaaaaacctcatcaatcacaactatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11057 - DNA, 359 bp, Artificial
  MsCOMT deletion introduced by TALEN pair MsCOMT_T02.1
tctcacaaaaacctcatcaatcacaactatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataaagctggacatggtgctcaaatttcacctcttgaaattgcttctcagctaccaacaactaaccctgatgcacccgttatgttggaccgaatgttgcgtctcctggcttgttacaatatcatcacttgttcttttcgtactcaacaagatggaaaggttcagagactttatggtttggctactgttgctaa

SEQ ID NO: 11058 - DNA, 358 bp, Artificial
  MsCOMT deletion introduced by TALEN pair MsCOMT_T02.1
tctcacaaaaacctcatcaatcacaaccttgggttcaacaggtgaaactcaaataacaccaacccacatatcagattaagaagcaaacctcttcgccatgcaattagcaagtgcttcagttcttcccatgattttaaaatcagctcttgaacttgatctcttagaaatcatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11059 - DNA, 361 bp, Artificial
  MsCOMT deletion introduced by TALEN pair MsCOMT_T02.1
tctcacaaaaacctcatcaatcacaaccttgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11060 - DNA, 352 bp, Artificial
  MsCOMT deletion introduced by TALEN pair MsCOMT_T02.1
tctcacaaaaacctcatcaatcacaaccttgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11061 - DNA, 356 bp, Artificial
  MsCOMT deletion introduced by TALEN pair MsCOMT_T02.1
tctcacaaaaacctcatcaatcacaaccttgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11062 - DNA, 361 bp, Artificial
  MsCOMT deletion introduced by TALEN pair MsCOMT_T02.1
tctcacaaaaacctcatcaatcacaaccgtgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11063 - DNA, 357 bp, Artificial
  MsCOMT deletion introduced by TALEN pair MsCOMT_T02.1
tctcacaaaaacctcatcaatcacaaccgtgggttcaacaggtgaaactcaaataacaccaacccacatatcagatgaagaagcaaacctcttcgccatgcaattagcaagtgcttcagttcttcccatgattttaaaatcagctcttgaacttgatctcttagaaaaagttggacctggtgctcaaatttcacctattgaaattgcttctcagctcccaacaactaaccctgatgcaccagttatgttggaccgaatgttgcgtctcttggcttgttacaatatcctcacttgttcagttcgtactcgacaagatggaaaggttcagagactttatggtttggctactgttgctaa

SEQ ID NO: 11064 - DNA, 358 bp, Artificial
  MsCOMT deletion introduced by TALEN pair MsCOMT_T02.1
tctcacaaaaacctcatcaatcacaaccgtgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11065 - DNA, 258 bp, Artificial
  MsCOMT deletion introduced by TALEN pair MsCOMT_T02.1
tctcacaaaaacctcatcaatcacaaccgggttcaacaggtgaaactcaaataacaccaacccacatatcagatgaagaagcaaacctcttcgccatgcaattagcaagtgcttcagttcttcccataaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11066 - DNA, 355 bp, Artificial
  MsCOMT deletion introduced by TALEN pair MsCOMT_T02.1
tctcacaaaaacctcatcaatcacaaccctgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11067 - DNA, 450 bp, Artificial
  MsCOMT deletion introduced by TALEN pair MsCOMT_T02.1
tctcacaaaaacctcatcaatcacaaccctgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgccggtgctgtgccaggcccacggcttgaccccggagcaggtggtagccatcgccagcaacgatggcggcaagcaggcgctggacctaatgatggacatggtgctcaaatttcagctattgaaattgctgctcagctcccaacaactaaccctgatgcaccagttatgttggaccgaatgttgcgtctcgtggcttgttacaatatcctcccttgttcagttcgtactcaacaagatggaaaggttcagagactagatggtttggctactgatgctaa

SEQ ID NO: 11068 - DNA, 353 bp, Artificial
  MsCOMT deletion introduced by TALEN pair MsCOMT_T02.1
tctcacaaaaacctcatcaatcacaaccctgggttcaacaggtgaaactcaaataacaccaacccacatatcagatgaagaagcaaacctcttcgccatgcaactagcaagtgcttcagttcttcccatgattttgaaatcagctcttgaacttgatctcttagaactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11069 - DNA, 310 bp, Artificial
  MsCOMT deletion introduced by TALEN pair MsCOMT_T02.1
tctcacaaaaacctcatcaatcacaaccctgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11070 - DNA, 360 bp, Artificial
  MsCOMT deletion introduced by TALEN pair MsCOMT_T02.1
tctcacaaaaacctcatcaatcacaaccctgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 11071 - DNA, 361 bp, Artificial
  MsCOMT deletion introduced by TALEN pair MsCOMT_T02.1
tctcacaaaaacctcatcaatcacaaccctgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagacgttagggtttggctactgttgctaa

SEQ ID NO: 11072 - DNA, 360 bp, Artificial
  MsCOMT deletion introduced by TALEN pair MsCOMT_T02.1
tctcacaaaaacctcatcaatcacaaccctgggttcaacaggtgaaactcaaataacaccaacccacatatcagatgaagaagcaaacctcttcgccatgcaactagcaagtgcttcagttcttaccatgattttgaaatcagctcttgaacttgatctcttagaaatcaaagctgtacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11073 - DNA, 357 bp, Artificial
  MsCOMT deletion introduced by TALEN pair MsCOMT_T02.1
tctcacaaaaacctcatcaatcacaaccattggttcaacaggtgaaactcaaataacaccaacccacatatcagatgaagaagcaaacctcttcgccatgcaattagcaagtgcttcagttcttcccatgattttaaaatcagctcttgaacttgatctcttagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11074 - DNA, 361 bp, Artificial
  MsCOMT deletion introduced by TALEN pair MsCOMT_T02.1
tctcacaaaaacctcatcaatcacaaccattggttcaacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgacattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11075 - DNA, 353 bp, Artificial
  MsCOMT deletion introduced by TALEN pair MsCOMT_T02.1
tctcacaaaaacctcatcaatcacaaccattggttcaacaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11076 - DNA, 355 bp, Artificial
  MsCOMT deletion introduced by TALEN pair MsCOMT_T02.1
tctcacaaaaacctcatcaatcacaaccattggttcaacaggtgaaactcaaataacaccaacccacatatcagatgaagaagcaaacctcttcgccatgcaattagcaagtgctccagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11077 - DNA, 355 bp, Artificial
  MsCOMT deletion introduced by TALEN pair MsCOMT_T02.1
tctcacaaaaacctcatcaatcacaaccattggttcaacaggtgaaactcaaataacaccaacccacatatcagatgaagaagcaaacctcttcgccatgcaactagcaagtgcttcagttcttcccatgattttgaaatcagctcttgaacttgatctcttggaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11078 - DNA, 347 bp, Artificial
  MsCOMT deletion introduced by TALEN pair MsCOMT_T02.1
tctcacaaaaacctcatcaatcacaaccattggttcaacaggtgaaactcaaataacaccaacccacatatcagatgaagaagcaaacctcttcgccatgcaactagcaagtgcttcagttcttcccatgattttgaaatcagctcttgaacttgatctcttagaaatggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11079 - DNA, 360 bp, Artificial
  MsCOMT deletion introduced by TALEN pair MsCOMT_T02.1
tctcacaaaaacctcatcaatcacaaccattggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11080 - DNA, 355 bp, Artificial
  MsCOMT deletion introduced by TALEN pair MsCOMT_T02.1
tctcacaaaaacctcatcaatcacaaccattggttcaacaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11081 - DNA, 356 bp, Artificial
  MsCOMT deletion introduced by TALEN pair MsCOMT_T02.1
tctcacaaaaacctcatcaatcacaaccattggttcaacaggtgaaactcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11082 - DNA, 360 bp, Artificial
  MsCOMT deletion introduced by TALEN pair MsCOMT_T02.1
tctcacaaaaacctcatcaatcacaaccatgtgttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11083 - DNA, 360 bp, Artificial
  MsCOMT deletion introduced by TALEN pair MsCOMT_T02.1
tctcacaaaaacctcatcaatcacaaccatgtgttcaacaggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11084 - DNA, 349 bp, Artificial
  MsCOMT deletion introduced by TALEN pair MsCOMT_T02.1
tctcacaaaaacctcatcaatcacaaccatggtttcaacaggtgaaactcaaataacaccaacccacatatcagacgaagaagcaaacctcttcgccatgcaattagcaagtgcttcagttcttcccatgattttaaaatcagctcttgaacttgattaaagctggacctggtgctcaaatttcacctattgaaattgcttctcagctcccaacaactaaccctgatgcaccagttatgttggaccgaatgttgcgtctctttgcttgttacaatatcctcacttgttcagttcgtactcaacaagatggaaaggttcagagactttatggtttggctactgttgctaa

SEQ ID NO: 11085 - DNA, 359 bp, Artificial
  MsCOMT deletion introduced by TALEN pair MsCOMT_T02.1
tctcacaaaaacctcatcaatcacaaccatggttccacagggggaaatcaaattacacccaacccaaataccgattaaaaaacaaacctcttcggcaatccaatagcaaatgcttcaggtcttcccatgattttaaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgccaa

SEQ ID NO: 11086 - DNA, 321 bp, Artificial
  MsCOMT deletion introduced by TALEN pair MsCOMT_T02.1
tctcacaaaaacctcatcaatcacaaccatggttcaacaggtggaaatccaataacacccaaccacctttcatatgaagaagcaaacctcttcgccatgcaattaacaagtggttcagttcttcccatgattttgaaatcagctcttgaacttgatctctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11087 - DNA, 359 bp, Artificial
  MsCOMT deletion introduced by TALEN pair MsCOMT_T02.1
tctcacaaaaacctcatcaatcacaaccatggttcaacaggtgaaactcaaataacaccaacccacatatcagatgaagaagcaaacctcttcgccatgcaattagcaagtgcttcagttcttcccatgattttgaaatcagctcttgaacttgatctcttagaaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11088 - DNA, 358 bp, Artificial
  MsCOMT deletion introduced by TALEN pair MsCOMT_T02.1
tctcacaaaaacctcatcaatcacaaccatggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11089 - DNA, 359 bp, Artificial
  MsCOMT deletion introduced by TALEN pair MsCOMT_T02.1
tctcacaaaaacctcatcaatcacaaccatggttcaacaggtgaaactcaaataaaaccaacccacatatcagatgaagaagcaaacctcttcgccattcaattagcaaatgcttcagttcttcccatgattttgaaagcagctcttgaacgtgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11090 - DNA, 360 bp, Artificial
  MsCOMT deletion introduced by TALEN pair MsCOMT_T02.1
tctcacaaaaacctcatcaatcacaaccatgggtttaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11091 - DNA, 361 bp, Artificial
  MsCOMT deletion introduced by TALEN pair MsCOMT_T02.1
tctcacaaaaacctcatcaatcacaaccatgggtttaacaggtgaaactcaaataacaccaacccacatatcagatgaagaagcaaacctcttcgccatgcaactagcaagtgcttcagttcttcccatgattttgaaatcagctcttgaacttgatctcttagaaatataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11092 - DNA, 352 bp, Artificial
  MsCOMT deletion introduced by TALEN pair MsCOMT_T02.1
tctcacaaaaacctcatcaatcacaaccatgggtttaacaggtgaaactcaaataacaccaacccacatatcagatgaagaagcaaacctcttcgccatgcaactagcaagtgcttcagttcttcccatgattttgaaatcagctcttgaacttgatctcttaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11093 - DNA, 358 bp, Artificial
  MsCOMT deletion introduced by TALEN pair MsCOMT_T02.1
tctcacaaaaacctcatcaatcacaaccatgggtttaacaggtgaaactcaaataacaccaacccacatatcagatgaagaagcaaacctcttcgccatgcaactagcaagtgcttcagttcttcccatgattttaaaatcagctcttgaacttgatctcttagaaatcatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11094 - DNA, 360 bp, Artificial
  MsCOMT deletion introduced by TALEN pair MsCOMT_T02.1
tctcacaaaaacctcatcaatcacaaccatgggttgaacaggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11095 - DNA, 359 bp, Artificial
  MsCOMT deletion introduced by TALEN pair MsCOMT_T02.1
tctcacaaaaacctcatcaatcacaaccatgggttgaacaggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11096 - DNA, 359 bp, Artificial
  MsCOMT deletion introduced by TALEN pair MsCOMT_T02.1
tctcacaaaaacctcatcaatcacaaccatgggttctacaggtgaaactcaaataacaccaacccacatatcagatgaagaagcaaacctcttcgccatgcaattagcaagtgcttcagttcttcccatgattttaaaatcagctcttgaacttgatctcttagaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11097 - DNA, 352 bp, Artificial
  MsCOMT deletion introduced by TALEN pair MsCOMT_T02.1
tctcacaaaaacctcatcaatcacaaccatgggttctacaggtgaaactcaaataacaccaacccacatatcagatgaagaagcaaacctcttcgccatgcaattagcaagtgcttcagttcttcccatgattttaaaatcagctcttgaacttgatctctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11098 - DNA, 359 bp, Artificial
  MsCOMT deletion introduced by TALEN pair MsCOMT_T02.1
tctcacaaaaacctcatcaatcacaaccatgggttcgacaggtgaaactcaaataacaccaacccgcatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11099 - DNA, 361 bp, Artificial
  MsCOMT deletion introduced by TALEN pair MsCOMT_T02.1
tctcacaaaaacctcatcaatcacaaccatgggttcgacaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11100 - DNA, 362 bp, Artificial
  MsCOMT deletion introduced by TALEN pair MsCOMT_T02.1
tctcacaaaaacctcatcaatcacaaccatgggttcgacaggtgaaactcaaataacaccaacccacatatcagatgaagaagcaaacctcttcgccatgcaattagcaagtgcttcagttcttcccatgattttaaaatcagctcttgaacttgatctcttagaaatcataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11101 - DNA, 361 bp, Artificial
  MsCOMT deletion introduced by TALEN pair MsCOMT_T02.1
tctcacaaaaacctcatcaatcacaaccatgggttcatcaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11102 - DNA, 353 bp, Artificial
  MsCOMT deletion introduced by TALEN pair MsCOMT_T02.1
tctcacaaaaacctcatcaatcacaaccatgggttcatcaggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11103 - DNA, 363 bp, Artificial
  MsCOMT deletion introduced by TALEN pair MsCOMT_T02.1
tctcacaaaaacctcatcaatcacaaccatgggttcagcaggtgaaactcaaataacaccaacccacatatcagatgaagaagcaaacctcttcgccatgcaattagcaagtgcttcagttcttcccatgattttgaaatcagctcttgaacttgatctcttagaaatcactaaagctggacctggtgctcaaatttcacctattgaaattgcttctcagctaccaacaactaaccctgatgcaccagttatgttggaccgaatgttgcgtctcctggcttgttacaatatcctcacttgttcagttcgtactcaacaagatggaaaggttcagagactttatggtttggctactgttgctaa

SEQ ID NO: 11104 - DNA, 358 bp, Artificial
  MsCOMT deletion introduced by TALEN pair MsCOMT_T02.1
tctcacaaaaacctcatcaatcacaaccatgggttcagcaggtgaaactcaaataacaccaacccacatatcagatgaagaagcaaacctcttcgccatgcaattagcaagtgcttcagttcttcccatgattttaaaatcagctcttgaacttgatctcttaggctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11105 - DNA, 361 bp, Artificial
  MsCOMT deletion introduced by TALEN pair MsCOMT_T02.1
tctcacaaaaacctcatcaatcacaaccatgggttcagcaggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11106 - DNA, 358 bp, Artificial
  MsCOMT deletion introduced by TALEN pair MsCOMT_T02.1
tctcacaaaaacctcatcaatcacaaccatgggttcagcaggtgaaactcaaataacaccaacccacatatcagatgaagaagcaaacctcttcgccatgcaattagcaagtgcttcagttcttcccatgattttaaaatcagctcttgaacttgatctcttagaaatcatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11107 - DNA, 360 bp, Artificial
  MsCOMT deletion introduced by TALEN pair MsCOMT_T02.1
tctcacaaaaacctcatcaatcacaaccatgggttcagcaggtgaaactcaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11108 - DNA, 260 bp, Artificial
  MsCOMT deletion introduced by TALEN pair MsCOMT_T02.1
tctcacaaaaacctcatcaatcacaaccatgggttcagcaggtgaaactcaaataacaccaacccacatatcagatgaagaagcaaacctcttcgccatgcaattagcaagtgcttcagttcttcccataaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11109 - DNA, 360 bp, Artificial
  MsCOMT deletion introduced by TALEN pair MsCOMT_T02.1
tctcacaaaaacctcatcaatcacaaccatgggttcagcaggtgaaactcaaataacaccaacccacatatcagatgaagaagcaaacctcttcgccatgcaactagcaagtgcttcagttcttcccatgattttgaaatcagctcttgaacttgatctcttagaacataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11110 - DNA, 395 bp, Artificial
  MsCOMT deletion introduced by TALEN pair MsCOMT_T02.1
tctcacaaaaacctcatcaatcacaaccatgggttcagcaggtgaaactcaaataacaccaacccacatatcagatgaagaagcaaacctcttcgccatgcaactagcaagtgcttcagttcttcccatgattttgaaatcagctcttgaacttgatctcttagaaatcatatctgctgcttgcaaacaaaaaaaccaccgctaccagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgcgaa

SEQ ID NO: 11111 - DNA, 359 bp, Artificial
  MsCOMT deletion introduced by TALEN pair MsCOMT_T02.1
tctcacaaaaacctcatcaatcacaaccatgggttcagcaggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11112 - DNA, 355 bp, Artificial
  MsCOMT deletion introduced by TALEN pair MsCOMT_T02.1
tctcacaaaaacctcatcaatcacaaccatgggttcagcaggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11113 - DNA, 357 bp, Artificial
  MsCOMT deletion introduced by TALEN pair MsCOMT_T02.1
tctcacaaaaacctcatcaatcacaaccatgggttcagcaggtgaaactcaaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctaccaacaactaaccctgatgcaccagttatgatggaccgaatgttgcgtctcttggcttgttacaatatcctcacttgttcagttcgtactcaacaagatggaaaggttcagagactttatggtttggctactgttgctaa

SEQ ID NO: 11114 - DNA, 353 bp, Artificial
  MsCOMT deletion introduced by TALEN pair MsCOMT_T02.1
tctcacaaaaacctcatcaatcacaaccatgggttcagcaggtgaaactcaaataacaccaacccacatatcagatgaagaagcaaacctcttcgccatgcaactagcaagtgcttcagttcttcccatgattttaaaatcagctcttgaacttgatctcttagagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11115 - DNA, 355 bp, Artificial
  MsCOMT deletion introduced by TALEN pair MsCOMT_T02.1
tctcacaaaaacctcatcaatcacaaccatgggttcagcaggtgaaactcaaataacaccaacccacatatcagatgaagaagcaaacctcttcgccatgcaactagcaagtgcttcagttcttcccatgattttaaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11116 - DNA, 361 bp, Artificial
  MsCOMT deletion introduced by TALEN pair MsCOMT_T02.1
tctcacaaaaacctcatcaatcacaaccatgggttcagcaggtgaaactcaaataacaccaacccacatatcagatgaagaagcaaacctcttcgccatgcaactagcaagtgcttcagttcttcccatgattttaaaatcagctcttgaacttgatctcttagaaatcaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11117 - DNA, 360 bp, Artificial
  MsCOMT deletion introduced by TALEN pair MsCOMT_T02.1
tctcacaaaaacctcatcaatcacaaccatgggttcaccaggttaaactcaaataacaccaacccacatatcagatgaagaagcaaacctcttcgccatgcaattagcaagtgcttcagttcttcccatgattttaaaatcagctcttgaacttgatctcttagaaattaaagctggacctgttgctcaaatttcacctattgaaattgcttctcagctaccaacaactaaccctgatgcaccagttatgttggaccgaatgttgagtctcttggattattacaatatcctcccttgttcagttcgtactcaacaagatggaaagattcagagactttatggtttggctactgttgctaa

SEQ ID NO: 11118 - DNA, 358 bp, Artificial
  MsCOMT deletion introduced by TALEN pair MsCOMT_T02.1
tctcacaaaaacctcatcaatcacaaccatgggttcaccaggtgaaactcaaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11119 - DNA, 350 bp, Artificial
  MsCOMT deletion introduced by TALEN pair MsCOMT_T02.1
tctcacaaaaacctcatcaatcacaaccatgggttcaccaggtgaaactcaaataacaccaacccacatatcagatgaagaagcaaacctcttcgccatgcaactagcaagtgcttcagttcttcccatgattttaaaatcagctcttgaacttgatctcttagaaatcatggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11120 - DNA, 359 bp, Artificial
  MsCOMT deletion introduced by TALEN pair MsCOMT_T02.1
tctcacaaaaacctcatcaatcacaaccatgggttcaccaggtgaaactaaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 11121 - DNA, 350 bp, Artificial
  MsCOMT deletion introduced by TALEN pair MsCOMT_T02.1
tctcacaaaaacctcatcaatcacaaccatgggttcacaggtgaaactcaaataacaccaacccacatatcagatgaagaagcaaacctcttcgccatgcaactagcaagtgcttcagttcttcccatgcttttgaaatcagctcttgaacttgatctcttagctggacctggtgctcaaatttcacctattgaaattgcttctcagctcccaacaactaaccctgatgcaccagttatgttggaccgaatgtggcgtctcttggcttgttacaatatcctcacttgttcagttcgtactcaacaagatggaaaggttcagagactttatggtttggatactgttgctaa

SEQ ID NO: 11122 - DNA, 358 bp, Artificial
  MsCOMT deletion introduced by TALEN pair MsCOMT_T02.1
tctcacaaaaacctcatcaatcacaaccatgggttcaataggtgaaactcaaataacaccaacccacatatcagatgaagaagcaaacctcttcgccatgcaattagcaagtgcttcagttcttcccatgattttaaaatcagctcttgaacttgatctcttagaaatcagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11123 - DNA, 357 bp, Artificial
  MsCOMT deletion introduced by TALEN pair MsCOMT_T02.1
tctcacaaaaacctcatcaatcacaaccatgggttcaataggtgaaactcaaataacaccaacccacatatcagatgaagaagcaaacctcttcgccatgcaattagcaagtgcttcagttcttcccatgattttaaaatcagctcttgaacttgatctcttagaaaaagttggaccttgtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11124 - DNA, 353 bp, Artificial
  MsCOMT deletion introduced by TALEN pair MsCOMT_T02.1
tctcacaaaaacctcatcaatcacaaccatgggttcaataggtgaaactcaaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11125 - DNA, 354 bp, Artificial
  MsCOMT deletion introduced by TALEN pair MsCOMT_T02.1
tctcacaaaaacctcatcaatcacaaccatgggttcaataggtgaaactcaaataacaccaacccacatatcagatgaagaagcaaacctcttcgccatgcaattagcaagtgcttcagttcttcccatgattttaaaatcagctcttgaacttgatctctcagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttctgagactttatggtttggctactgttgctaa

SEQ ID NO: 11126 - DNA, 358 bp, Artificial
  MsCOMT deletion introduced by TALEN pair MsCOMT_T02.1
tctcacaaaaacctcatcaatcacaaccatgggttcaataggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11127 - DNA, 360 bp, Artificial
  MsCOMT deletion introduced by TALEN pair MsCOMT_T02.1
tctcacaaaaacctcatcaatcacaaccatgggttcaataggtgaaactcaaataacaccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11128 - DNA, 359 bp, Artificial
  MsCOMT deletion introduced by TALEN pair MsCOMT_T02.1
tctcacaaaaacctcatcaatcacaaccatgggttcaataggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11129 - DNA, 359 bp, Artificial
  MsCOMT deletion introduced by TALEN pair MsCOMT_T02.1
tctcacaaaaacctcatcaatcacaaccatgggttcaataggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11130 - DNA, 355 bp, Artificial
  MsCOMT deletion introduced by TALEN pair MsCOMT_T02.1
tctcacaaaaacctcatcaatcacaaccatgggttcaataggtgaaactcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11131 - DNA, 367 bp, Artificial
  MsCOMT deletion introduced by TALEN pair MsCOMT_T02.1
tctcacaaaaacctcatcaatcacaaccatgggttcaataggtgaaactcaaataacaccaacccacatatcagatgaagaagcaaacctcttcgccatgaaactagcaagtgcttcagttcttcccatgattttaaaatcagctcttgaacttgatctcttagaaatcatttgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11132 - DNA, 347 bp, Artificial
  MsCOMT deletion introduced by TALEN pair MsCOMT_T02.1
tctcacaaaaacctcatcaatcacaaccatgggttcaagaggtgaaactcaaataacaccaacccacatatcagatgaagaagcaaacctcttcgccatgcaactagcaagtgcttcagttcttcccatgattttgaaatcagctcttgaacttgagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11133 - DNA, 352 bp, Artificial
  MsCOMT deletion introduced by TALEN pair MsCOMT_T02.1
tctcacaaaaacctcatcaatcacaaccatgggttcaactggtgaaactcaaataacaccaacccacatatcagatgaagaagcaaacctcttcgccatgcaattagcaagtgcttcagttcttcccatgattttgaaatcagctcttgaacttgatctcttagaaatcacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11134 - DNA, 356 bp, Artificial
  MsCOMT deletion introduced by TALEN pair MsCOMT_T02.1
tctcacaaaaacctcatcaatcacaaccatgggttcaactggtgaaactcaaataacaccaacccacatatcagatgaagaagcaaacctcttcgccatgcaattagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11135 - DNA, 358 bp, Artificial
  MsCOMT deletion introduced by TALEN pair MsCOMT_T02.1
tctcacaaaaacctcatcaatcacaaccatgggttcaactggtgaaactcaaataacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11136 - DNA, 360 bp, Artificial
  MsCOMT deletion introduced by TALEN pair MsCOMT_T02.1
tctcacaaaaacctcatcaatcacaaccatgggttcaactggtgaaactcaaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11137 - DNA, 361 bp, Artificial
  MsCOMT deletion introduced by TALEN pair MsCOMT_T02.1
tctcacaaaaacctcatcaatcacaaccatgggttcaactggtgaaactcaaataacaccaacccacatatcagatgaagaagcaaacctcttcgccatgcaattagcaagtgcttcagttcttcccatgattttaaaatcagctcttgaacttgatctcttagaaatcaaaagctggacctggtgctcaaatttcacttgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11138 - DNA, 353 bp, Artificial
  MsCOMT deletion introduced by TALEN pair MsCOMT_T02.1
tctcacaaaaacctcatcaatcacaaccatgggttcaactggtgaaactcaaataacaccaacccacatatcagatgaagaagcaaacctcttcgccatgcaactagcaagtgcttcagttcttcccatgattttgaaatcagctcttgaacttgatctcttagaactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11139 - DNA, 360 bp, Artificial
  MsCOMT deletion introduced by TALEN pair MsCOMT_T02.1
tctcacaaaaacctcatcaatcacaaccatgggttcaactggtgaaactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11140 - DNA, 361 bp, Artificial
  MsCOMT deletion introduced by TALEN pair MsCOMT_T02.1
tctcacaaaaacctcatcaatcacaaccatgggttcaactggtgaaactcaaataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagcctttatggtttggctactgttgctaa

SEQ ID NO: 11141 - DNA, 358 bp, Artificial
  MsCOMT deletion introduced by TALEN pair MsCOMT_T02.1
tctcacaaaaacctcatcaatcacaaccatgggttcaactggtgaaactcaaataacaccaacccacatatcagatgaagaagcaaacctcttcgccatgcaactagcaagtgcttcagttcttcccatgattttaaaatcagctcttgaacttgatctcttagaaatcagctggacctggtgctcaaatttcacctattgaaattgcttctcagctcccaacaactaaccctgatgcaccagttatgtcggaccgaatgttgcgtctcttggcttgttacaatatcctcacttgttcagttcgtactcaacaagatggaaaggttcagagactttatggtttggctactgttgctaa

SEQ ID NO: 11142 - DNA, 353 bp, Artificial
  MsCOMT deletion introduced by TALEN pair MsCOMT_T02.1
tctcacaaaaacctcatcaatcacaaccatgggttcaactggtgaaactcaaataacaccaacccacatatcagatgaagaagcaaacctcttcgccatgcaactagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11143 - DNA, 357 bp, Artificial
  MsCOMT deletion introduced by TALEN pair MsCOMT_T02.1
tctcacaaaaacctcatcaatcacaaccatgggttcaactggtgaaactcaaataaaaccaacccacatatcagatgaagaagcaaacctcttcgccatgcaactagcaagtgcttcagttcttcccatgattttgaaatcagctcttgaacttgatctcttagataaagctggacctggtgctcaaatttcacctattgaaattgcttctcagctaccaacaactaaccctgatgcaccagttatgttggagcgaatgttgcgtctcttggcttgttacaatatcctcacttgttcagttcgtactcaacaagatggaaaggttcagagactttatggtttggctactgttgctaa

SEQ ID NO: 11144 - DNA, 361 bp, Artificial
  MsCOMT deletion introduced by TALEN pair MsCOMT_T02.1
tctcacaaaaacctcatcaatcacaaccatgggttcaacgggtgaaactcaaataacaccaacccacatatcagatgaagaagcaaacctcttcgccatgcaattagcgagtgcttcagttcttcccatgattttgaaatcagctcttgaacttgatctcttagaaagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggcgactgttgctaa

SEQ ID NO: 11145 - DNA, 361 bp, Artificial
  MsCOMT deletion introduced by TALEN pair MsCOMT_T02.1
tctcacaaaaacctcatcaatcacaaccatgggttcaacgggtgaaactcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11146 - DNA, 349 bp, Artificial
  MsCOMT deletion introduced by TALEN pair MsCOMT_T02.1
tctcacaaaaacctcatcaatcacaaccatgggttcaacgggtgaaactcaaataacaccaacccacatatcagatgaagaagcaaacctcttcgccatgcaattagcaagtgcttcagttcttcccatgattttaaaatcagctcttgaacttgatctcttagaaatcaggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11147 - DNA, 359 bp, Artificial
  MsCOMT deletion introduced by TALEN pair MsCOMT_T02.1
tctcacaaaaacctcatcaatcacaaccatgggttcaacgggtgaaactcaaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11148 - DNA, 359 bp, Artificial
  MsCOMT deletion introduced by TALEN pair MsCOMT_T02.1
tctcacaaaaacctcatcaatcacaaccatgggttcaacgggtgaaactcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11149 - DNA, 355 bp, Artificial
  MsCOMT deletion introduced by TALEN pair MsCOMT_T02.1
tctcacaaaaacctcatcaatcacaaccatgggttcaacgggtgaaactcaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11150 - DNA, 356 bp, Artificial
  MsCOMT deletion introduced by TALEN pair MsCOMT_T02.1
tctcacaaaaacctcatcaatcacaaccatgggttcaacgggtgaaactcaaataacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11151 - DNA, 345 bp, Artificial
  MsCOMT deletion introduced by TALEN pair MsCOMT_T02.1
tctcacaaaaacctcatcaatcacaaccatgggttcaacgggtgaaactcaaataacaccaacccacatatcagatgaagaagcaaacctcttcgccatgcaattagcaagtgcttcagttcttcccatgattttaaaatcagctcttgaacttaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 11152 - DNA, 360 bp, Artificial
  MsCOMT deletion introduced by TALEN pair MsCOMT_T02.1
tctcacaaaaacctcatcaatcacaaccatgggttcaacgggtgaaactcaaataacaccaacccacatatcagatgaagaagcaaacctcttcgccatgcaattagcaagtgcttcagttcttcccatgatcttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11153 - DNA, 293 bp, Artificial
  MsCOMT deletion introduced by TALEN pair MsCOMT_T02.1
tctcacaaaaacctcatcaatcacaaccatgggttcaacgggtgaaactcaaataacaccaacccacatatcagatgaagaagcaaacctcttcgccatgcaactagcaagtgcttcagttcttcccatgattttgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 11154 - DNA, 343 bp, Artificial
  MsCOMT deletion introduced by TALEN pair MsCOMT_T02.1
tctcacaaaaacctcatcaatcacaaccatgggttcaacgggtgaaactcaaataacaccaacccacatatcagatgaagaagcaaacctcttcgccatgcaactagcaagtgcttcagttcttcccatgattttgaaatcagctcttgaacttgatctcttagaatgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11155 - DNA, 358 bp, Artificial
  MsCOMT deletion introduced by TALEN pair MsCOMT_T02.1
tctcacaaaaacctcatcaatcacaaccatgggttcaacgggtgaaactcaaataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 11156 - DNA, 361 bp, Artificial
  MsCOMT deletion introduced by TALEN pair MsCOMT_T02.1
tctcacaaaaacctcatcaatcacaaccatgggttcaacgggtgaaactcaaataacaccaacccacatatcagatgaagaagcaaacctcttcgccatgcaactagcaagtgcttcagttcttcccatgattttgaaatcagctcttgaacttgatctcttagaaatcataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11157 - DNA, 362 bp, Artificial
  MsCOMT deletion introduced by TALEN pair MsCOMT_T02.1
tctcacaaaaacctcatcaatcacaaccatgggttcaacgggtgaaactcaaataacaccaacccacatatcagatgaagaagcaaacctcttcgccatgcaactagcaagtgcttcagttcttcccatgattttgaaatcagctcttgaacttgatctcttagaaatcataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 11158 - DNA, 359 bp, Artificial
  MsCOMT deletion introduced by TALEN pair MsCOMT_T02.1
tctcacaaaaacctcatcaatcacaaccatgggttcaacgggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11159 - DNA, 359 bp, Artificial
  MsCOMT deletion introduced by TALEN pair MsCOMT_T02.1
tctcacaaaaacctcatcaatcacaaccatgggttcaacgggtgaaactcaaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 11160 - DNA, 359 bp, Artificial
  MsCOMT deletion introduced by TALEN pair MsCOMT_T02.1
tctcacaaaaacctcatcaatcacaaccatgggttcaacgggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11161 - DNA, 359 bp, Artificial
  MsCOMT deletion introduced by TALEN pair MsCOMT_T02.1
tctcacaaaaacctcatcaatcacaaccatgggttcaacgggtgaaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11162 - DNA, 349 bp, Artificial
  MsCOMT deletion introduced by TALEN pair MsCOMT_T02.1
tctcacaaaaacctcatcaatcacaaccatgggttcaacgggtgaaactcaaataacaccaacccacatatcagatgaagaagcaaacctcttcgccatgcaactagcaagtgcttcagttcttcccatgattttgaaatcagctcttgaacttgatctcttagaaacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11163 - DNA, 356 bp, Artificial
  MsCOMT deletion introduced by TALEN pair MsCOMT_T02.1
tctcacaaaaacctcatcaatcacaaccatgggttcaacgggtgaaactcaaataacaccaacccacatatcagatgaagaagcaaacctcttcgccatgcaactagcaagtgcttcagttcttcccatgattttgaaatcagctcttgaacttgatctcttactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11164 - DNA, 353 bp, Artificial
  MsCOMT deletion introduced by TALEN pair MsCOMT_T02.1
tctcacaaaaacctcatcaatcacaaccatgggttcaacgggtgaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11165 - DNA, 344 bp, Artificial
  MsCOMT deletion introduced by TALEN pair MsCOMT_T02.1
tctcacaaaaacctcatcaatcacaaccatgggttcaacgggtgaaactcaaataacaccaacccacatatcagatgaagaagcaaacctcttcgccatgcaactagcaagtgcttcagttcttcccatgattttgaaatcagctcttgaactaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11166 - DNA, 365 bp, Artificial
  MsCOMT deletion introduced by TALEN pair MsCOMT_T02.1
tctcacaaaaacctcatcaatcacaaccatgggttcaacgggtgaaactcaaataacaccaacccacatatcagatgaagaagcaaacctcttcgccatgcaactagcaagtgcttcagttcttcccatgattttaaaatcagctcttgaacttgatctcttagaaatcttgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11167 - DNA, 351 bp, Artificial
  MsCOMT deletion introduced by TALEN pair MsCOMT_T02.1
tctcacaaaaacctcatcaatcacaaccatgggttcaacgggtgaaactcaaataacaccaacccacatatcagatgaagaagcaaacctcttcgccatgcaactagcaagtgcttcagttcttcccatgattttaaaatcagctcttgaacttgatctcttaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttgctactgttgctaa

SEQ ID NO: 11168 - DNA, 355 bp, Artificial
  MsCOMT deletion introduced by TALEN pair MsCOMT_T02.1
tctcacaaaaacctcatcaatcacaaccatgggttcaaccggtgaaactcaaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagacattatggtttggctactgttgctaa

SEQ ID NO: 11169 - DNA, 348 bp, Artificial
  MsCOMT deletion introduced by TALEN pair MsCOMT_T02.1
tctcacaaaaacctcatcaatcacaaccatgggttcaaccggtgaaactcaaataacaccaacccacatatcagatgaagaagcaaacctcttcaccatgcaattagcaagtgcttcagttcttcccatgattttaaaatcagctcttgaacttgatctcttagaacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11170 - DNA, 360 bp, Artificial
  MsCOMT deletion introduced by TALEN pair MsCOMT_T02.1
tctcacaaaaacctcatcaatcacaaccatgggttcaacatgtgaaactcaaataacaccaacccacatatcagatgaagaagcaaacctcttcgccatgcaattagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtcctcaacaagatggaaaggtacagagcctttatggtttggctactgttgctaa

SEQ ID NO: 11171 - DNA, 356 bp, Artificial
  MsCOMT deletion introduced by TALEN pair MsCOMT_T02.1
tctcacaaaaacctcatcaatcacaaccatgggttcaacatgtgaaactcaaataacaccaacccacatatcagatgaagaagcaaacctcttcgccatgcaattagcaagtgcttcagttcttcccatgattttaaaatcagctcttgaacttgatctcttataaaatagctgaacctggtgctcaaatttcacctattgaaattgcttatcagctcccaacatctaaccctgatgcaccagttatgttggagagaatgttgcgtatcttggcttgttacaatatactctcttggtcagttcgtactcaaaaagatggaaagatacagagactttatggtttggctacagtcgaa

SEQ ID NO: 11172 - DNA, 393 bp, Artificial
  MsCOMT deletion introduced by TALEN pair MsCOMT_T02.1
tctcacaaaaacctcatcaatcacaaccatgggttcaacatgtgaaactcaaataacaccaacccacatatcagatgaagaagcaaacctcttcgccatgcaattagcaagtgcttcagttcttcccatgattttaaaatcagctcttgaacttgatctcttagaaatcatcgttgcgttaagccaacacccggcagcgtttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11173 - DNA, 361 bp, Artificial
  MsCOMT deletion introduced by TALEN pair MsCOMT_T02.1
tctcacaaaaacctcatcaatcacaaccatgggttcaacatgtgaaactcaaataacaccaacccacatatcagatgaagaagcaaacctcttcgccatgcaattagcaagtgcttcagttcttcccatgattttaaaatcagctcttgaacttgatctcttagaaatcataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11174 - DNA, 356 bp, Artificial
  MsCOMT deletion introduced by TALEN pair MsCOMT_T02.1
tctcacaaaaacctcatcaatcacaaccatgggttcaacatgtgaaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctacgttgctaa

SEQ ID NO: 11175 - DNA, 363 bp, Artificial
  MsCOMT deletion introduced by TALEN pair MsCOMT_T02.1
tctcacaaaaacctcatcaatcacaaccatgggttcaacatgtgaaactcaaataacaccaacccacatatcagatgaagaagcaaacctcttcgccatgcaactagcaagtgcttcagttcttcccattattttgaaatcagctcttgaacttgatctcttagaaatcactaaagctgcacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11176 - DNA, 358 bp, Artificial
  MsCOMT deletion introduced by TALEN pair MsCOMT_T02.1
tctcacaaaaacctcatcaatcacaaccatgggttcaacatgtgaaactcaaataacaccaacccacatatcagatgaagaagcaaacctcttcgccatgcaactagcaagtgcttcagttcttcccatgattttaaaatcagctcttgaacttgatctcttagaaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11177 - DNA, 344 bp, Artificial
  MsCOMT deletion introduced by TALEN pair MsCOMT_T02.1
tctcacaaaaacctcatcaatcacaaccatgggttcaacatgggaaactcaaataacaccaacccacatatcagatgaagaagcaaacctcatggccatgcaattcgcaatgccttcatttcttcccatgattttgaaatcagctcttgagctaaagctggacctggtgctcagatttcacctattgaaattgcttctcagctaccaacaactacccctgatgcaccagttatgttggaccgaatgttgcgtctcttggcttgttccaatatcctcacttggtaagttcgtactcaaccagatggaaaagttcagagactttatggtttggctactgttgctaa

SEQ ID NO: 11178 - DNA, 354 bp, Artificial
  MsCOMT deletion introduced by TALEN pair MsCOMT_T02.1
tctcacaaaaacctcatcaatcacaaccatgggttcaacagttgaaactcaaataacaccaacccacatatcagatgaagaagcaaacctcttcgccatgcaactagcaagtgcttcagttcttcccatgattttgaaatcagctcttgaacttgatctcttagaagctggacctggtgctcaaatttcacccattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11179 - DNA, 355 bp, Artificial
  MsCOMT deletion introduced by TALEN pair MsCOMT_T02.1
tctcacaaaaacctcatcaatcacaaccatgggttcaacagttgaaactcaaacaacaccaacccacatatcagatgaagaagcaaacctcttcgccacgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11180 - DNA, 363 bp, Artificial
  MsCOMT deletion introduced by TALEN pair MsCOMT_T02.1
tctcacaaaaacctcatcaatcacaaccatgggttcaacaggttaaactcaaataacaccaacccacatatcagatgaagaagcaaacctcttcgccatgcaattagcaagtgcttcagttcttcccatgattttgaaatcagctcttgaacttgatctcttagaaatcgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11181 - DNA, 357 bp, Artificial
  MsCOMT deletion introduced by TALEN pair MsCOMT_T02.1
tctcacaaaaacctcatcaatcacaaccatgggttcaacaggttaaactcaaataacaccaacccacatatcagatgaagaagcaaacctcttcgccatgcaatcagcaagtgcttcagttcttcccatgattttaaaatcagctcttgaacttgatctcttagaaatcattggacctggtgctcaaatttcacctattgaaattgcttctcagctcctaacaactaaccctgatgcaccagttatgttggaccgaatgttgcttctcttggcttgttacaatatcctcacttgttcagttcgtactcaacaagatggaaaggttcagagactttatggtttggctactgttgctaa

SEQ ID NO: 11182 - DNA, 293 bp, Artificial
  MsCOMT deletion introduced by TALEN pair MsCOMT_T02.1
tctcacaaaaacctcatcaatcacaaccatgggttcaacaggttaaactcaaataacaccaacccacatatcagatgaagaagcaaacctcttcgccatgcaactagcaagtgcttcagttcttcccatgattttgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11183 - DNA, 353 bp, Artificial
  MsCOMT deletion introduced by TALEN pair MsCOMT_T02.1
tctcacaaaaacctcatcaatcacaaccatgggttcaacaggttaaactcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcgcctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11184 - DNA, 357 bp, Artificial
  MsCOMT deletion introduced by TALEN pair MsCOMT_T02.1
tctcacaaaaacctcatcaatcacaaccatgggttcaacaggtgtaactcaaataacaccaacccacatatcagatgaagaagcaaacctcttcgccatgcaattagcaagtgcttcagttcttcccatgattttaaaatcagctcttgaacttgatctcttagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11185 - DNA, 359 bp, Artificial
  MsCOMT deletion introduced by TALEN pair MsCOMT_T02.1
tctcacaaaaacctcatcaatcacaaccatgggttcaacaggtgtaactcaaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 11186 - DNA, 357 bp, Artificial
  MsCOMT deletion introduced by TALEN pair MsCOMT_T02.1
tctcacaaaaacctcatcaatcacaaccatgggttcaacaggtggaactcaaataacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11187 - DNA, 345 bp, Artificial
  MsCOMT deletion introduced by TALEN pair MsCOMT_T02.1
tctcacaaaaacctcatcaatcacaaccatgggttcaacaggtggaactcaaataacaccaacccacatatcagatgaagaagcaaacctcttcgccatgcaactagcaagtgcttcagttcttcccatgattttgaaaccagctcttgaacttaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagggtcagagactttatggtttggctactgttgctaa

SEQ ID NO: 11188 - DNA, 362 bp, Artificial
  MsCOMT deletion introduced by TALEN pair MsCOMT_T02.1
tctcacaaaaacctcatcaatcacaaccatgggttcaacaggtggaactcaaataacaccaacccacatatcagatgaagaagcaaacctcttcgccatgcaactagcaagtgcttcagttcttcccatgattttaaaatcagctcttgaacttgatctcttagaaatcataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 11189 - DNA, 435 bp, Artificial
  MsCOMT deletion introduced by TALEN pair MsCOMT_T02.1
tctcacaaaaacctcatcaatcacaaccatgggttcaacaggtgcaactcaaataacaccaacccacatatcagatgaagaagcaaacctcttcgccatgcaattagcaagtgcttcagttcttcccatgattttaaaatcagctcttgaacttgatctcttagaaatcattgaccccggagcaggtggtggccatcgccagccacgatggcggcaagcaggcgctggagacggtccagcggctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11190 - DNA, 359 bp, Artificial
  MsCOMT deletion introduced by TALEN pair MsCOMT_T02.1
tctcacaaaaacctcatcaatcacaaccatgggttcaacaggtgcaactcaaataacaccaacccacatatcagatgaagaagcaaacctcttcgccatgcaattagcaactgcttcagttcttcccatgattttgaaatcagctcttgaacttgatctcttagaaataaagctggacctggtgctcaaatttcacctattgaaattgcttctcagctcccaacaactaaccctgatgcacaagttaggttggacagaatgttgcgtctcttggctggtgacaatatcctaacttgttcagttcgtaatcaacaagatggaaaggtgcagagactttatggtttggctactgttgctaa

SEQ ID NO: 11191 - DNA, 450 bp, Artificial
  MsCOMT deletion introduced by TALEN pair MsCOMT_T02.1
tctcacaaaaacctcatcaatcacaaccatgggttcaacaggtgatactcaaataacaccaacccacatatcagatgaagaagcaaacctcttcgccatgcaattagcaagtgcttcagttcttcccatgattttaaaatcagctcttgaacttgatctcttagaaatcattgccggtgctgtgccaggcccacggcttgaccccggagcaggtggtggcaatcgccagcaacgatggcggcaagcaggcgctggacctaaagctggacctggtgctcaaatttcacctattgaaattgcttctcagcccccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11192 - DNA, 358 bp, Artificial
  MsCOMT deletion introduced by TALEN pair MsCOMT_T02.1
tctcacaaaaacctcatcaatcacaaccatgggttcaacaggtgagactcaaataacaccaacccacatatcagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11193 - DNA, 293 bp, Artificial
  MsCOMT deletion introduced by TALEN pair MsCOMT_T02.1
tctcacaaaaacctcatcaatcacaaccatgggttcaacaggtgagactcaaataacaccaacccacatatcagatgaagaagcaaacctcttcgccatgcaactagcaagtgcttcagttcttcccatgattttgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11194 - DNA, 360 bp, Artificial
  MsCOMT deletion introduced by TALEN pair MsCOMT_T02.1
tctcacaaaaacctcatcaatcacaaccatgggttcaacaggtgagactcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11195 - DNA, 362 bp, Artificial
  MsCOMT deletion introduced by TALEN pair MsCOMT_T02.1
tctcacaaaaacctcatcaatcacaaccatgggttcaacaggtgacactcaaataacaccaacccacatatcagatgaagaagcaaacctcttcgccatgcaattagcaagtgcttcagttcttcccatgattttaaaatcagctcttgaacttgatctcttagaaatcctaaagctggacctggtgctcaaatttcacctattgaaattgcttctcagctaccaacaactaaccctgatgcaccagttatgttggaccgaatgttgcgtctcttggcttgttacaatatcctcacttgttcagtgcgtactcaacaagatggaaaggttcagagactttatggtttggctacggttgctaa

SEQ ID NO: 11196 - DNA, 361 bp, Artificial
  MsCOMT deletion introduced by TALEN pair MsCOMT_T02.1
tctcacaaaaacctcatcaatcacaaccatgggttcaacaggtgacactcaaataacaccaacccacatatcagatgaagaagaaaacctcttcgccatgcaattagcaagtgcttcagttcttcccaagattttaaaatcagctctttaacttgatctcttagaaatctaaagctggacctggttcttacatttcagctgttcaaattgcttctcagcttgcaacaactaaccctgatgcaccagttatgttggaccgaatgttgcgtctcttggcttgttacaataaactcccttgtttagttcgtactgaacaagattgaaagggtcagagacaatatggtttggctactgttgctaa

SEQ ID NO: 11197 - DNA, 362 bp, Artificial
  MsCOMT deletion introduced by TALEN pair MsCOMT_T02.1
tctcacaaaaacctcatcaatcacaaccatgggttcaacaggtgaatctcaaataacaccaacccacatatcagatgaagaagcaaacctcttcgccatgcaattagcaagtgcttcagttcttcccatgattttgaaatcagctcttgaacttgatctcttagaaatcataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11198 - DNA, 359 bp, Artificial
  MsCOMT deletion introduced by TALEN pair MsCOMT_T02.1
tctcacaaaaacctcatcaatcacaaccatgggttcaacaggtgaatctcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11199 - DNA, 360 bp, Artificial
  MsCOMT deletion introduced by TALEN pair MsCOMT_T02.1
tctcacaaaaacctcatcaatcacaaccatgggttcaacaggtgaatctcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcgtgttacaatatcctcacttgttctgttcgtactcaacaagatggaaaggttcagagactttatggtttggctactgttgctaa

SEQ ID NO: 11200 - DNA, 356 bp, Artificial
  MsCOMT deletion introduced by TALEN pair MsCOMT_T02.1
tctcacaaaaacctcatcaatcacaaccatgggttcaacaggtgaatctcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11201 - DNA, 353 bp, Artificial
  MsCOMT deletion introduced by TALEN pair MsCOMT_T02.1
tctcacaaaaacctcatcaatcacaaccatgggttcaacaggtgaatctcaaataacaccaacccacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11202 - DNA, 360 bp, Artificial
  MsCOMT deletion introduced by TALEN pair MsCOMT_T02.1
tctcacaaaaacctcatcaatcacaaccatgggttcaacaggtgaagctcaaataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11203 - DNA, 247 bp, Artificial
  MsCOMT deletion introduced by TALEN pair MsCOMT_T02.1
tctcacaaaaacctcatcaatcacaaccatgggttcaacaggtgaagctcaaataacaccaacccacatatcagatgaagaagcaaacctcttcgccatgcaactagcaagtgcttcagttcttcccatgattttgaaatcagctcttgaacttgatctcttagaaatacaatatcctcacttgttcagttcgtactcaacaagatggaaaagttcagagactttatggtttggctactgttgctaa

SEQ ID NO: 11204 - DNA, 355 bp, Artificial
  MsCOMT deletion introduced by TALEN pair MsCOMT_T02.1
tctcacaaaaacctcatcaatcacaaccatgggttcaacaggtgaagctcaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11205 - DNA, 356 bp, Artificial
  MsCOMT deletion introduced by TALEN pair MsCOMT_T02.1
tctcacaaaaacctcatcaatcacaaccatgggttcaacaggtgaacctcaaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaagttgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11206 - DNA, 351 bp, Artificial
  MsCOMT deletion introduced by TALEN pair MsCOMT_T02.1
tctcacaaaaacctcatcaatcacaaccatgggttcaacaggtgaaattcaaataacaccaacccacatatcagatgaagaagcaaacctcttcgccatgcaattagcaagtgcttcagttcttcccatgattttaaaatcagctcttgaacttgatcttaaagctggacctggtgctcaaatttcacctattgaaattgcttctcagctcccaacaactaaccctgattcaccagttatgttggaccgaatattgcgtctcttggcttgttacaatatcctcacttgttcagttcgtactcaacaagatggaaaagttcagagactttatggtttggcgactgttgctaa

SEQ ID NO: 11207 - DNA, 361 bp, Artificial
  MsCOMT deletion introduced by TALEN pair MsCOMT_T02.1
tctcacaaaaacctcatcaatcacaaccatgggttcaacaggtgaaattcaaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 11208 - DNA, 359 bp, Artificial
  MsCOMT deletion introduced by TALEN pair MsCOMT_T02.1
tctcacaaaaacctcatcaatcacaaccatgggttcaacaggtgaaattcaaataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11209 - DNA, 352 bp, Artificial
  MsCOMT deletion introduced by TALEN pair MsCOMT_T02.1
tctcacaaaaacctcatcaatcacaaccatgggttcaacaggtgaaattcaaataacaccaacccacatatcagatgaagaagcaaacctcttcgccatgcaattagcaagtgcttcagttcttcccatgattttaaaatcagctcttgaacttgatctcttaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11210 - DNA, 350 bp, Artificial
  MsCOMT deletion introduced by TALEN pair MsCOMT_T02.1
tctcacaaaaacctcatcaatcacaaccatgggttcaacaggtgaaattcaaataacaccaacccacatatcagatgaagaagcaaacctcttcgccatgcaattagcaagtgcttcagttcttcccatgattttaaaatcagctcttgaacttgatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11211 - DNA, 424 bp, Artificial
  MsCOMT deletion introduced by TALEN pair MsCOMT_T02.1
tctcacaaaaacctcatcaatcacaaccatgggttcaacaggtgaaacttaaataacaccaacccacatatcagatgaagaagcaaacctcttcgccatgcaattagcaagtgcttcagttcttcccatgattttgaaatcagctcttgaacttgatctcttagaaatcagcaggtgttggccatcgccagcaatattggtgccaagcaggcgctggagacggtgcaggcgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11212 - DNA, 361 bp, Artificial
  MsCOMT deletion introduced by TALEN pair MsCOMT_T02.1
tctcacaaaaacctcatcaatcacaaccatgggttcaacaggtgaaacttaaataacaccaacccacatatcagatgaagaagcaaacctcttcgccatgcaattagcaagtgcttcagttcttcccatgattttgaaatcagctcttgaacttgatctcttagaaagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11213 - DNA, 352 bp, Artificial
  MsCOMT deletion introduced by TALEN pair MsCOMT_T02.1
tctcacaaaaacctcatcaatcacaaccatgggttcaacaggtgaaacttaaataacaccaacccacatatcagatgaagaagcaaacctcttcgccatgcaattagcaagtgcttcagttcttcccatgattttaaaatcatctcttgaacttgatctcttaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11214 - DNA, 360 bp, Artificial
  MsCOMT deletion introduced by TALEN pair MsCOMT_T02.1
tctcacaaaaacctcatcaatcacaaccatgggttcaacaggtgaaacttaaataacaccaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11215 - DNA, 355 bp, Artificial
  MsCOMT deletion introduced by TALEN pair MsCOMT_T02.1
tctcacaaaaacctcatcaatcacaaccatgggttcaacaggtgaaacttaaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11216 - DNA, 362 bp, Artificial
  MsCOMT deletion introduced by TALEN pair MsCOMT_T02.1
tctcacaaaaacctcatcaatcacaaccatgggttcaacaggtgaaacttaaataacaccaacccacatatcagatgaagaagcaaacctcttcgccatgcaactagcaagtgcttcagttcttcccatgattttgaaatcagctcttgaacttgatctcttagaaatcctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11217 - DNA, 355 bp, Artificial
  MsCOMT deletion introduced by TALEN pair MsCOMT_T02.1
tctcacaaaaacctcatcaatcacaaccatgggttcaacaggtgaaacttaaataacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11218 - DNA, 360 bp, Artificial
  MsCOMT deletion introduced by TALEN pair MsCOMT_T02.1
tctcacaaaaacctcatcaatcacaaccatgggttcaacaggtgaaactctaataacaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11219 - DNA, 361 bp, Artificial
  MsCOMT deletion introduced by TALEN pair MsCOMT_T02.1
tctcacaaaaacctcatcaatcacaaccatgggttcaacaggtgaaactctaataacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11220 - DNA, 358 bp, Artificial
  MsCOMT deletion introduced by TALEN pair MsCOMT_T02.1
tctcacaaaaacctcatcaatcacaaccatgggttcaacaggtgaaactctaataacaccaacccacatatcagatgaagaagcaaacctcttcgccatgcaattagcaagtgcttcagttcttcccatgattttaaaatcagctcttgaacttgatctcttagaaatcatctggacctggtgctcaaatttcacctgttcaaattgcttctcagcttccaacaactaaccctgatgcactagtcatgttggaccgaatgttgcgtctcttggcttgttacaatatcctcacttgttctgttcgtactcaacaagatggaaaggttcagagactttatggtttggctactgttgctaa

SEQ ID NO: 11221 - DNA, 354 bp, Artificial
  MsCOMT deletion introduced by TALEN pair MsCOMT_T02.1
tctcacaaaaacctcatcaatcacaaccatgggttcaacaggtgaaactcgaataacaccaacccacatatcagatgaagaagcaaacctcttcgccatgcaattagcaagtgcttcagttcttcccatgattttgaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11222 - DNA, 351 bp, Artificial
  MsCOMT deletion introduced by TALEN pair MsCOMT_T02.1
tctcacaaaaacctcatcaatcacaaccatgggttcaacaggtgaaactcgaataacaccaacccacatatcagatgaagaagcaaacctcttcgccatgcaattagcaagtgcttcagttcttcccatgattttaaaatcagctcttgaacttgatctcttagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11223 - DNA, 358 bp, Artificial
  MsCOMT deletion introduced by TALEN pair MsCOMT_T02.1
tctcacaaaaacctcatcaatcacaaccatgggttcaacaggtgaaactcgaataacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11224 - DNA, 354 bp, Artificial
  MsCOMT deletion introduced by TALEN pair MsCOMT_T02.1
tctcacaaaaacctcatcaatcacaaccatgggttcaacaggtgaaactcgaataacaccaacccacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11225 - DNA, 354 bp, Artificial
  MsCOMT deletion introduced by TALEN pair MsCOMT_T02.1
tctcacaaaaacctcatcaatcacaaccatgggttcaacaggtgaaactcgaataacaccaacccacatatcagatgaagaagcaaacctcttcgccatgcaattagcaagtgcttcagttcttcccatgattttaaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctacgttgctaa

SEQ ID NO: 11226 - DNA, 359 bp, Artificial
  MsCOMT deletion introduced by TALEN pair MsCOMT_T02.1
tctcacaaaaacctcatcaatcacaaccatgggttcaacaggtgaaactcgaataacaccaacccacatatcagatgaagaagcaaacctcttcgccatgcaattagcaagtgcttcagttcttcccatgattttaaaatcagctcttgaacttgatctcttagaaatcaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11227 - DNA, 353 bp, Artificial
  MsCOMT deletion introduced by TALEN pair MsCOMT_T02.1
tctcacaaaaacctcatcaatcacaaccatgggttcaacaggtgaaactcgaataacaccaacccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11228 - DNA, 361 bp, Artificial
  MsCOMT deletion introduced by TALEN pair MsCOMT_T02.1
tctcacaaaaacctcatcaatcacaaccatgggttcaacaggtgaaactcgaataacaccaacccacatatcagatgaagaagcaaacctcttcgccatgcaactagcaagtgcttcagttcttcccatgattttgaaatcagctcttgaacttgatctcttagaaatttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11229 - DNA, 360 bp, Artificial
  MsCOMT deletion introduced by TALEN pair MsCOMT_T02.1
tctcacaaaaacctcatcaatcacaaccatgggttcaacaggtgaaactcgaataacaccaacccacatatcagatgaagaagcaaacctcttcgccatgcaactagcaagtgcttcagttcttcccatgattttgaaatcagctcttgaacttgatctcttagaaattaaagctggacctggtactcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11230 - DNA, 365 bp, Artificial
  MsCOMT deletion introduced by TALEN pair MsCOMT_T02.1
tctcacaaaaacctcatcaatcacaaccatgggttcaacaggtgaaactcgaataacaccaacccacatatcagatgaagaagcaaacctcttcgccatgcaactagcaagtgcttcagttcttcccatgattttgaaatcagctcttgaacttgatctcttagaaatcatgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11231 - DNA, 359 bp, Artificial
  MsCOMT deletion introduced by TALEN pair MsCOMT_T02.1
tctcacaaaaacctcatcaatcacaaccatgggttcaacaggtgaaactcgaataacaccaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11232 - DNA, 358 bp, Artificial
  MsCOMT deletion introduced by TALEN pair MsCOMT_T02.1
tctcacaaaaacctcatcaatcacaaccatgggttcaacaggtgaaactcgaataacaccaacccacatatcagatgaagaagcaaacctcttcgccatgcaactagcaagtgcttcagttcttcccatgattttgaaatcagctcttgaacttgatctcttagaaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11233 - DNA, 359 bp, Artificial
  MsCOMT deletion introduced by TALEN pair MsCOMT_T02.1
tctcacaaaaacctcatcaatcacaaccatgggttcaacaggtgaaactcgaataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11234 - DNA, 360 bp, Artificial
  MsCOMT deletion introduced by TALEN pair MsCOMT_T02.1
tctcacaaaaacctcatcaatcacaaccatgggttcaacaggtgaaactcgaataacaccaacccacatatcagatgaagaagcaaacctcttcgccatgcaactagcaagtgcttcagttcttcccatgattttgaaatcagctcttgaacttgatctcttagaaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11235 - DNA, 356 bp, Artificial
  MsCOMT deletion introduced by TALEN pair MsCOMT_T02.1
tctcacaaaaacctcatcaatcacaaccatgggttcaacaggtgaaactcgaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11236 - DNA, 357 bp, Artificial
  MsCOMT deletion introduced by TALEN pair MsCOMT_T02.1
tctcacaaaaacctcatcaatcacaaccatgggttcaacaggtgaaactcgaataacaccaacccacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11237 - DNA, 359 bp, Artificial
  MsCOMT deletion introduced by TALEN pair MsCOMT_T02.1
tctcacaaaaacctcatcaatcacaaccatgggttcaacaggtgaaactcgaataacaccaacccacatatcagatgaagaagcaaacctcttcgccatgcaactagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11238 - DNA, 358 bp, Artificial
  MsCOMT deletion introduced by TALEN pair MsCOMT_T02.1
tctcacaaaaacctcatcaatcacaaccatgggttcaacaggtgaaactccaataacaccaacccacatatcagatgaagaagcaaacctcttcgccatgcaattagcaagtgcttcagttcttcccatgattttaaaatcagctcttgaacttgatctcttagaataaagctggacctggtgctcaaatttcacctattgaaatttcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11239 - DNA, 355 bp, Artificial
  MsCOMT deletion introduced by TALEN pair MsCOMT_T02.1
tctcacaaaaacctcatcaatcacaaccatgggttcaacaggtgaaactccaataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11240 - DNA, 360 bp, Artificial
  MsCOMT deletion introduced by TALEN pair MsCOMT_T02.1
tctcacaaaaacctcatcaatcacaaccatgggttcaacaggtgaaactccaataacaccaacccacatatcagatgaagaagcaaacctcttcgccatgcaactagcaagtgcttcagttcttcccatgattttaaaatcagctcttgaacttgatctcttagaaactaaagctggacctgatgctcaaatttcacctattgaaatttcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 11241 - DNA, 364 bp, Artificial
  MsCOMT deletion introduced by TALEN pair MsCOMT_T02.1
tctcacaaaaacctcatcaatcacaaccatgggttcaacaggtgaaactcatataacaccaacccacatatcagatgaagaagcaaacctcttcgccatgcaattagcaagtgcttcagttcttcccatgattttaaaatcagctcttgaacttgatctcttagaaatcagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11242 - DNA, 360 bp, Artificial
  MsCOMT deletion introduced by TALEN pair MsCOMT_T02.1
tctcacaaaaacctcatcaatcacaaccatgggttcaacaggtgaaactcagataactccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctcccaacaactaaccctgatgcaccagttatgttggaccgaatgttgcgtctcttggctggttacaatatcctcacttgttcagttcgtactcaacaagatggaaaagttcagagactttatggtttggctactgttgctaa

SEQ ID NO: 11243 - DNA, 359 bp, Artificial
  MsCOMT deletion introduced by TALEN pair MsCOMT_T02.1
tctcacaaaaacctcatcaatcacaaccatgggttcaacaggtgaaactcagataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctattgaaattgcttctcagctaccaacaactaaccctgatgcaccagtcatgttggaccgaatgttgcgtcacttggcttgttacaatatcctcacttgttctgttcgtactcaacaagatggaaaggttcagagactttatggtttggctactgttgctaa

SEQ ID NO: 11244 - DNA, 359 bp, Artificial
  MsCOMT deletion introduced by TALEN pair MsCOMT_T02.1
tctcacaaaaacctcatcaatcacaaccatgggttcaacaggtgaaactcagataacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11245 - DNA, 355 bp, Artificial
  MsCOMT deletion introduced by TALEN pair MsCOMT_T02.1
tctcacaaaaacctcatcaatcacaaccatgggttcaacaggtgaaactcagataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttgagttcgtactcaacaagatggaaagattcagagactttatggtttggctactgttgctaa

SEQ ID NO: 11246 - DNA, 354 bp, Artificial
  MsCOMT deletion introduced by TALEN pair MsCOMT_T02.1
tctcacaaaaacctcatcaatcacaaccatgggttcaacaggtgaaactcagataacaccaacccacatatcagatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctaccaacaactaaccctgatgcaccagttatgttggaccgaatgttcgtctcttggcttgttacaatatcctcacttgttcagttcgtactcaacaagatggaaaggttcagagactttatggtttggctactgttgctaa

SEQ ID NO: 11247 - DNA, 358 bp, Artificial
  MsCOMT deletion introduced by TALEN pair MsCOMT_T02.1
tctcacaaaaacctcatcaatcacaaccatgggttcaacaggtgaaactcagataacaccaacccacatatcagatgaagaagcaaacctcttcgccatgcaactagcaagtgcttcagttcttcccatgattttgaaatcagctcttgaacttgatctcttagaataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 11248 - DNA, 361 bp, Artificial
  MsCOMT deletion introduced by TALEN pair MsCOMT_T02.1
tctcacaaaaacctcatcaatcacaaccatgggttcaacaggtgaaactcagataacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11249 - DNA, 359 bp, Artificial
  MsCOMT deletion introduced by TALEN pair MsCOMT_T02.1
tctcacaaaaacctcatcaatcacaaccatgggttcaacaggtgaaactcagataacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11250 - DNA, 359 bp, Artificial
  MsCOMT deletion introduced by TALEN pair MsCOMT_T02.1
tctcacaaaaacctcatcaatcacaaccatgggttcaacaggtgaaactcacataacaccaacccacatatccgatgcagaagcaaacctcttcgccatgcaattagcaagtgcttcagttcttcccatgattttgaaatcagctcttgaacttgatctcttagaaataaagctggccctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 11251 - DNA, 357 bp, Artificial
  MsCOMT deletion introduced by TALEN pair MsCOMT_T02.1
tctcacaaaaacctcatcaatcacaaccatgggttcaacaggtgaaactcacataacaccaacccacatatcagatgaagaagcaaacctcttcgccatgcaattagcaagtgcttcagttcttcccatgattttaaaatcagctcttgaacttgatctcttagaaatcgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagtctttatggtttggctactgttgctaa

SEQ ID NO: 11252 - DNA, 360 bp, Artificial
  MsCOMT deletion introduced by TALEN pair MsCOMT_T02.1
tctcacaaaaacctcatcaatcacaaccatgggttcaacaggtgaaactcacataacaccaacccacatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11253 - DNA, 355 bp, Artificial
  MsCOMT deletion introduced by TALEN pair MsCOMT_T02.1
tctcacaaaaacctcatcaatcacaaccatgggttcaacaggtgaaactcaattaacaccaacccacatatcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11254 - DNA, 361 bp, Artificial
  MsCOMT deletion introduced by TALEN pair MsCOMT_T02.1
tctcacaaaaacctcatcaatcacaaccatgggttcaacaggtgaaactcaattaacaccaacccacaaatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11255 - DNA, 354 bp, Artificial
  MsCOMT deletion introduced by TALEN pair MsCOMT_T02.1
tctcacaaaaacctcatcaatcacaaccatgggttcaacaggtgaaactcaatcacaccaacccacatatcagatgaagaagcaaacctcttcgccatgcaattagcaagtgcttcagttcttcccatgattttaaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 11256 - DNA, 355 bp, Artificial
  MsCOMT deletion introduced by TALEN pair MsCOMT_T02.1
tctcacaaaaacctcatcaatcacaaccatgggttcaacaggtgaaactcaataacaccaacccacatatcagatgaagaagcaaacctcttcgccatgcaattagcaagtgcttcagttcttcccatgattttaaaatcagctcttgaaattgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11257 - DNA, 355 bp, Artificial
  MsCOMT deletion introduced by TALEN pair MsCOMT_T02.1
tctcacaaaaacctcatcaatcacaaccatgggttcaacaggtgaaactcaataacaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11258 - DNA, 355 bp, Artificial
  MsCOMT deletion introduced by TALEN pair MsCOMT_T02.1
tctcacaaaaacctcatcaatcacaaccatgggttcaacaggtgaaactcaagtaacaccaacccacatatcagatgaagaagcaaacctcttcgccatgcaattagcaagtgcttcagttcttcccatgattttaaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11259 - DNA, 361 bp, Artificial
  MsCOMT deletion introduced by TALEN pair MsCOMT_T02.1
tctcacaaaaacctcatcaatcacaaccatgggttcaacaggtgaaactcaagtaacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11260 - DNA, 345 bp, Artificial
  MsCOMT deletion introduced by TALEN pair MsCOMT_T02.1
tctcacaaaaacctcatcaatcacaaccatgggttcaacaggtgaaactcaagtaacaccaacccacatatcagatgaagaagcaaacctcttcgccatgcaattagcaagtgcttcagttcttcccatgattttaaaatcagctcttgaacttgaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11261 - DNA, 361 bp, Artificial
  MsCOMT deletion introduced by TALEN pair MsCOMT_T02.1
tctcacaaaaacctcatcaatcacaaccatgggttcaacaggtgaaactcaagtaacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11262 - DNA, 359 bp, Artificial
  MsCOMT deletion introduced by TALEN pair MsCOMT_T02.1
tctcacaaaaacctcatcaatcacaaccatgggttcaacaggtgaaactcaagtaacaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11263 - DNA, 353 bp, Artificial
  MsCOMT deletion introduced by TALEN pair MsCOMT_T02.1
tctcacaaaaacctcatcaatcacaaccatgggttcaacaggtgaaactcaactaacaccaacccacatatcagatgaagaagcaaacctcttcgccatgcaattagcaagtgcttcagttcttcccatgattttgaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgataa

SEQ ID NO: 11264 - DNA, 361 bp, Artificial
  MsCOMT deletion introduced by TALEN pair MsCOMT_T02.1
tctcacaaaaacctcatcaatcacaaccatgggttcaacaggtgaaactcaactaacaccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcggctcttggcgtgttacaatatcctcacttgttcagttcgtactcaacaagatggaaaggttcagagactttatggtttggcgactgttgctaa

SEQ ID NO: 11265 - DNA, 359 bp, Artificial
  MsCOMT deletion introduced by TALEN pair MsCOMT_T02.1
tctcacaaaaacctcatcaatcacaaccatgggttcaacaggtgaaactcaactaacaccaacccacatatcagatgaagaagcaaacctcttcgccatgcaactagcaagtgcttcagttcttcccatgattttgaaatcagctcttgaacttgatctcttagaaatcatgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttgtggtttggctactgttgctaa

SEQ ID NO: 11266 - DNA, 222 bp, Artificial
  MsCOMT deletion introduced by TALEN pair MsCOMT_T02.1
tctcacaaaaacctcatcaatcacaaccatgggttcaacaggtgaaactcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 11267 - DNA, 222 bp, Artificial
  MsCOMT deletion introduced by TALEN pair MsCOMT_T02.1
tctcacaaaaacctcatcaatcacaaccatgggttcaacaggtgaaactcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11268 - DNA, 222 bp, Artificial
  MsCOMT deletion introduced by TALEN pair MsCOMT_T02.1
tctcacaaaaacctcatcaatcacaaccatgggttcaacaggtgaaactcaaatttcacctattgaaattgtttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11269 - DNA, 222 bp, Artificial
  MsCOMT deletion introduced by TALEN pair MsCOMT_T02.1
tctcacaaaaacctcatcaatcacaaccatgggttcaacaggtgaaactcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 11270 - DNA, 222 bp, Artificial
  MsCOMT deletion introduced by TALEN pair MsCOMT_T02.1
tctcacaaaaacctcatcaatcacaaccatgggttcaacaggtgaaactcaaatttcacctattgaaattgcttctcagctcccaacaactaaccctgatgcaccagttatgttggacctaatgttgcgtctcttggcttgttacaatatcctcacttgttcagttcgtactcaacaagatggaaaggttcagagactttatggtttggctactgttgctaa

SEQ ID NO: 11271 - DNA, 222 bp, Artificial
  MsCOMT deletion introduced by TALEN pair MsCOMT_T02.1
tctcacaaaaacctcatcaatcacaaccatgggttcaacaggtgaaactcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 11272 - DNA, 223 bp, Artificial
  MsCOMT deletion introduced by TALEN pair MsCOMT_T02.1
tctcacaaaaacctcatcaatcacaaccatgggttcaacaggtgaaactcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttgggctactgttgctaa

SEQ ID NO: 11273 - DNA, 222 bp, Artificial
  MsCOMT deletion introduced by TALEN pair MsCOMT_T02.1
tctcacaaaaacctcatcaatcacaaccatgggttcaacaggtgaaactcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11274 - DNA, 222 bp, Artificial
  MsCOMT deletion introduced by TALEN pair MsCOMT_T02.1
tctcacaaaaacctcatcaatcacaaccatgggttcaacaggtgaaactcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11275 - DNA, 222 bp, Artificial
  MsCOMT deletion introduced by TALEN pair MsCOMT_T02.1
tctcacaaaaacctcatcaatcacaaccatgggttcaacaggtgaaactcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11276 - DNA, 222 bp, Artificial
  MsCOMT deletion introduced by TALEN pair MsCOMT_T02.1
tctcacaaaaacctcatcaatcacaaccatgggttcaacaggtgaaactcaaatttcacctattgaaattgcttctcagctcccaacaactaaccctgatgcaccagttatattggaccgaatgttgcgtctcttggcttgttacaatatcctcacttgttcagttcgtactcaacaagatggaaagattcagagactttatggtttggctactgttgctaa

SEQ ID NO: 11277 - DNA, 222 bp, Artificial
  MsCOMT deletion introduced by TALEN pair MsCOMT_T02.1
tctcacaaaaacctcatcaatcacaaccatgggttcaacaggtgaaactcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 11278 - DNA, 222 bp, Artificial
  MsCOMT deletion introduced by TALEN pair MsCOMT_T02.1
tctcacaaaaacctcatcaatcacaaccatgggttcaacaggtgaaactcaaatttcacctattgaaattgcttctcagctaccaacaactaaccctgatgctccagttatgttggaccgaatgttgcgtctcttggcttgttacaatatcctcacttgttcagttcgtactcaacaagatggaaaggttcagagactttatggtttggctactgttgctaa

SEQ ID NO: 11279 - DNA, 222 bp, Artificial
  MsCOMT deletion introduced by TALEN pair MsCOMT_T02.1
tctcacaaaaacctcatcaatcacaaccatgggttcaacaggtgaaactcaaatttcacctattgaaattgcttctcagctaccaacaactaaccctgatgcatcagttatgttggaccgaatgttgcgtctcttggcttgttacaatatcctcacttgttcagttcgtactcaacaagatggaaagattcagagactttatggtttggctactgttgctaa

SEQ ID NO: 11280 - DNA, 222 bp, Artificial
  MsCOMT deletion introduced by TALEN pair MsCOMT_T02.1
tctcacaaaaacctcatcaatcacaaccatgggttcaacaggtgaaactcaaatttcacctattgaaattgcttctcagctaccaacaactaaccctgatgcaccagttatgttggactgaatgttgcgtctcttggcttgttacaatatcctcacttgttcagttcgtactcaacaagatggaaaggttcagagactttatggtttggctactgttgctaa

SEQ ID NO: 11281 - DNA, 222 bp, Artificial
  MsCOMT deletion introduced by TALEN pair MsCOMT_T02.1
tctcacaaaaacctcatcaatcacaaccatgggttcaacaggtgaaactcaaatttcacctattgaaattgcttctcagctaccaacaactaaccctgatgcaccagttatgttggaccgaatgttgtgtctcttggcttgttacaatatcctcacttgttcagttcgtactcaacaagatggaaaggttcagagactttatggtttggctactgttgctaa

SEQ ID NO: 11282 - DNA, 222 bp, Artificial
  MsCOMT deletion introduced by TALEN pair MsCOMT_T02.1
tctcacaaaaacctcatcaatcacaaccatgggttcaacaggtgaaactcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 11283 - DNA, 222 bp, Artificial
  MsCOMT deletion introduced by TALEN pair MsCOMT_T02.1
tctcacaaaaacctcatcaatcacaaccatgggttcaacaggtgaaactcaaatttcacctattgaaattgcttctcagctaccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 11284 - DNA, 222 bp, Artificial
  MsCOMT deletion introduced by TALEN pair MsCOMT_T02.1
tctcacaaaaacctcatcaatcacaaccatgggttcaacaggtgaaactcaaatttcacctattgaaattgcttctcagctaccaacaactaaccctgatgcaccagttatgttggaccgaatgttgcgtctcttggcttgttacaatatcctcacttgttcagttcgtgctcaacaagatggaaaagttcagagactttatggtttggctactgttgctaa

SEQ ID NO: 11285 - DNA, 222 bp, Artificial
  MsCOMT deletion introduced by TALEN pair MsCOMT_T02.1
tctcacaaaaacctcatcaatcacaaccatgggttcaacaggtgaaactcaaatttcacctattgaaattgcttctcagctaccaacaactaaccctgatgcaccagttatgttggaccgaatgttgcgtctcttggcttgttacaatatcctcacttgttcagttcgtactcaaccagatggaaaggttcagagactttatggtttggctactgttgctaa

SEQ ID NO: 11286 - DNA, 222 bp, Artificial
  MsCOMT deletion introduced by TALEN pair MsCOMT_T02.1
tctcacaaaaacctcatcaatcacaaccatgggttcaacaggtgaaactcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11287 - DNA, 221 bp, Artificial
  MsCOMT deletion introduced by TALEN pair MsCOMT_T02.1
tctcacaaaaacctcatcaatcacaaccatgggttcaacaggtgaaactcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggttggctactgttgctaa

SEQ ID NO: 11288 - DNA, 222 bp, Artificial
  MsCOMT deletion introduced by TALEN pair MsCOMT_T02.1
tctcacaaaaacctcatcaatcacaaccatgggttcaacaggtgaaactcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctattgttgctaa

SEQ ID NO: 11289 - DNA, 222 bp, Artificial
  MsCOMT deletion introduced by TALEN pair MsCOMT_T02.1
tctcacaaaaacctcatcaatcacaaccatgggttcaacaggtgaaactcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11290 - DNA, 222 bp, Artificial
  MsCOMT deletion introduced by TALEN pair MsCOMT_T02.1
tctcacaaaaacctcatcaatcacaaccatgggttcaacaggtgaaactcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11291 - DNA, 222 bp, Artificial
  MsCOMT deletion introduced by TALEN pair MsCOMT_T02.1
tctcacaaaaacctcatcaatcacaaccatgggttcaacaggtgaaactcaaatttcacctattgaaattgcttctcagctaccaacaactaaccctgatgcaccagttatgttggaccgaatgttgcgtctcctggcttgttacaatatcctcacttgttcagttcgtactcaacaagatggaaaggttcagagactttatggtttggctactgttgctaa

SEQ ID NO: 11292 - DNA, 222 bp, Artificial
  MsCOMT deletion introduced by TALEN pair MsCOMT_T02.1
tctcacaaaaacctcatcaatcacaaccatgggttcaacaggtgaaactcaaatttcacctattgaaattgcttctcagctaccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 11293 - DNA, 222 bp, Artificial
  MsCOMT deletion introduced by TALEN pair MsCOMT_T02.1
tctcacaaaaacctcatcaatcacaaccatgggttcaacaggtgaaactcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 11294 - DNA, 222 bp, Artificial
  MsCOMT deletion introduced by TALEN pair MsCOMT_T02.1
tctcacaaaaacctcatcaatcacaaccatgggttcaacaggtgaaactcaaatttcacctattgaaattgcttctcagctaccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 11295 - DNA, 222 bp, Artificial
  MsCOMT deletion introduced by TALEN pair MsCOMT_T02.1
tctcacaaaaacctcatcaatcacaaccatgggttcaacaggtgaaactcaaatttcacctattgaaattgcgtctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11296 - DNA, 359 bp, Artificial
  MsCOMT deletion introduced by TALEN pair MsCOMT_T02.1
tctcacaaaaacctcatcaatcacaaccatgggttcaacaggtgaaactcaaattacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaataagatggaaaggttcagagactttatggtttggctactgttgctaa

SEQ ID NO: 11297 - DNA, 359 bp, Artificial
  MsCOMT deletion introduced by TALEN pair MsCOMT_T02.1
tctcacaaaaacctcatcaatcacaaccatgggttcaacaggtgaaactcaaattacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 11298 - DNA, 359 bp, Artificial
  MsCOMT deletion introduced by TALEN pair MsCOMT_T02.1
tctcacaaaaacctcatcaatcacaaccatgggttcaacaggtgaaactcaaattacaccaacccacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11299 - DNA, 357 bp, Artificial
  MsCOMT deletion introduced by TALEN pair MsCOMT_T02.1
tctcacaaaaacctcatcaatcacaaccatgggttcaacaggtgaaactcaaattacaccaacccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11300 - DNA, 356 bp, Artificial
  MsCOMT deletion introduced by TALEN pair MsCOMT_T02.1
tctcacaaaaacctcatcaatcacaaccatgggttcaacaggtgaaactcaaatgacaccaacccacatatcagatgaagaagcaaacctcttcgccatgcaattagcaagtgcttcagttcttcccatgattttgaaatcagctcttgaacttgatctcttagaaatcctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11301 - DNA, 361 bp, Artificial
  MsCOMT deletion introduced by TALEN pair MsCOMT_T02.1
tctcacaaaaacctcatcaatcacaaccatgggttcaacaggtgaaactcaaatgacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11302 - DNA, 361 bp, Artificial
  MsCOMT deletion introduced by TALEN pair MsCOMT_T02.1
tctcacaaaaacctcatcaatcacaaccatgggttcaacaggtgaaactcaaatgacaccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11303 - DNA, 351 bp, Artificial
  MsCOMT deletion introduced by TALEN pair MsCOMT_T02.1
tctcacaaaaacctcatcaatcacaaccatgggttcaacaggtgaaactcaaatatcaccaacccacatatcagatgaagaagcaaacctcttcgccatgcaattagcaagtgcttcagttcttcccatgattttaaaatcagctcttgaacttgatctcttagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11304 - DNA, 359 bp, Artificial
  MsCOMT deletion introduced by TALEN pair MsCOMT_T02.1
tctcacaaaaacctcatcaatcacaaccatgggttcaacaggtgaaactcaaatatcaccaacccacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11305 - DNA, 360 bp, Artificial
  MsCOMT deletion introduced by TALEN pair MsCOMT_T02.1
tctcacaaaaacctcatcaatcacaaccatgggttcaacaggtgaaactcaaatagcaccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11306 - DNA, 356 bp, Artificial
  MsCOMT deletion introduced by TALEN pair MsCOMT_T02.1
tctcacaaaaacctcatcaatcacaaccatgggttcaacaggtgaaactcaaatagcaccaacccacatatcagatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11307 - DNA, 355 bp, Artificial
  MsCOMT deletion introduced by TALEN pair MsCOMT_T02.1
tctcacaaaaacctcatcaatcacaaccatgggttcaacaggtgaaactcaaataccaccaacccacatatcagatgaagaagcaaacctcttcgccatgcaattagcaagtgcttcagttcttcccatgattttaaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11308 - DNA, 390 bp, Artificial
  MsCOMT deletion introduced by TALEN pair MsCOMT_T02.1
tctcacaaaaacctcatcaatcacaaccatgggttcaacaggtgaaactcaaataccaccaacccacatatcagatgaagaagcaaacctcttcgccatgcaactagcaagtgcttcagttcttcccatgattttgaaatcagctcttgaacttgatctcttagaaatcattgctggcgatggccaccacctgctccctaaacctggacctggtgctcaaatttcacctattgaaattgcttctcagctaccaacacctaaccctgatgcaccagttatgttggaccgaatgttgcgtctcttggcttgttacaatatcctcacttgttcagttcgtactcaacaagatggaaaggttcagagactttatggtttggctacagttgctaa

SEQ ID NO: 11309 - DNA, 355 bp, Artificial
  MsCOMT deletion introduced by TALEN pair MsCOMT_T02.1
tctcacaaaaacctcatcaatcacaaccatgggttcaacaggtgaaactcaaatacaccaacccacatatcagatgaagaagcaaacctcttcgccatgcaattagcaagtgcttcagttcttcccatgattttaaaatcagctcttgaacttgatctcttagaaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 11310 - DNA, 345 bp, Artificial
  MsCOMT deletion introduced by TALEN pair MsCOMT_T02.1
tctcacaaaaacctcatcaatcacaaccatgggttcaacaggtgaaactcaaatacaccaacccacatatcagatgaagaagcaaacctcttcgccatgcaactagcaagtgcttcagttcttcccatgattttgaaatcagctcttgaacttgaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11311 - DNA, 351 bp, Artificial
  MsCOMT deletion introduced by TALEN pair MsCOMT_T02.1
tctcacaaaaacctcatcaatcacaaccatgggttcaacaggtgaaactcaaataataccaacccacatatcagatgaagaagcaaacctcttcgccatgcaattagcaagtgcttcagttcttcccatgattttaaaatcagctcttgaacttgatctctaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11312 - DNA, 355 bp, Artificial
  MsCOMT deletion introduced by TALEN pair MsCOMT_T02.1
tctcacaaaaacctcatcaatcacaaccatgggttcaacaggtgaaactcaaataataccaacccacatatcagatgaagaagcaaacctcttcgccatgcaactagcaagtgcttcagttcttcccatgattttgaaatcagctcttgaacttgatctcttataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11313 - DNA, 360 bp, Artificial
  MsCOMT deletion introduced by TALEN pair MsCOMT_T02.1
tctcacaaaaacctcatcaatcacaaccatgggttcaacaggtgaaactcaaataataccaacccacatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11314 - DNA, 361 bp, Artificial
  MsCOMT deletion introduced by TALEN pair MsCOMT_T02.1
tctcacaaaaacctcatcaatcacaaccatgggttcaacaggtgaaactcaaataactccaacccacatatcagatgaagaagcaaacctcttcgccatgcaattagcaagtgcttcagtttttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtcacttggctggtgacaatatcctcacttgttcaggtcgtactcaacaagatggaaaggttcagagactttatggtttggctactgtagctaa

SEQ ID NO: 11315 - DNA, 345 bp, Artificial
  MsCOMT deletion introduced by TALEN pair MsCOMT_T02.1
tctcacaaaaacctcatcaatcacaaccatgggttcaacaggtgaaactcaaataactccaacccacatatcagatgaagaagcaaacctcttcgccatgcaattagcaagtgcttcagttcttcccatgattttaaaatcagctcttgaagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11316 - DNA, 361 bp, Artificial
  MsCOMT deletion introduced by TALEN pair MsCOMT_T02.1
tctcacaaaaacctcatcaatcacaaccatgggttcaacaggtgaaactcaaataacgccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11317 - DNA, 361 bp, Artificial
  MsCOMT deletion introduced by TALEN pair MsCOMT_T02.1
tctcacaaaaacctcatcaatcacaaccatgggttcaacaggtgaaactcaaataacgccaacccacatatcagatgaagaagcaaacctcttcgccatgcaattagcaagtgcttcagttcttcccatgattttaaaatcagctcttgaacttgatctcttagaatcctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11318 - DNA, 360 bp, Artificial
  MsCOMT deletion introduced by TALEN pair MsCOMT_T02.1
tctcacaaaaacctcatcaatcacaaccatgggttcaacaggtgaaactcaaataacgccaacccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11319 - DNA, 361 bp, Artificial
  MsCOMT deletion introduced by TALEN pair MsCOMT_T02.1
tctcacaaaaacctcatcaatcacaaccatgggttcaacaggtgaaactcaaataacgccaacccacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11320 - DNA, 365 bp, Artificial
  MsCOMT deletion introduced by TALEN pair MsCOMT_T02.1
tctcacaaaaacctcatcaatcacaaccatgggttcaacaggtgaaactcaaataacgccaacccacatatcagatgaagaagcaaacctcttcgccatgcaattagcaagtgcttcagttcttcccatgattttaaaatcagctcttgaacttgatctcttagaaatcattgctaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11321 - DNA, 364 bp, Artificial
  MsCOMT deletion introduced by TALEN pair MsCOMT_T02.1
tctcacaaaaacctcatcaatcacaaccatgggttcaacaggtgaaactcaaataacgccaacccacatatcagatgaagaagcaaacctcttcgccatgcaattagcaagtgcttcagttcttcccatgattttaaaatcagctcttgaacttgatctcttagaaatcagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11322 - DNA, 361 bp, Artificial
  MsCOMT deletion introduced by TALEN pair MsCOMT_T02.1
tctcacaaaaacctcatcaatcacaaccatgggttcaacaggtgaaactcaaataacgccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11323 - DNA, 353 bp, Artificial
  MsCOMT deletion introduced by TALEN pair MsCOMT_T02.1
tctcacaaaaacctcatcaatcacaaccatgggttcaacaggtgaaactcaaataacgccaacccacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11324 - DNA, 360 bp, Artificial
  MsCOMT deletion introduced by TALEN pair MsCOMT_T02.1
tctcacaaaaacctcatcaatcacaaccatgggttcaacaggtgaaactcaaataacgccaacccacatatcagatgaagaagcaaacctcttcgccatgcaactagcaagtgcttcagatcttcccatgcttttgaaatcagctcttgaacttgatctcttagaaattaaagctggacctggtgctcaaatgtcacctattgtcattgcttctcagctacctacaactaaccctgatgcaccagttatgttggaccgaatgttgcgtctattggcttgttacaatatcctcacttgttcagttcgtactcaacaaaatggaaaggttcagagactttatgagttggctactgtggctaa

SEQ ID NO: 11325 - DNA, 361 bp, Artificial
  MsCOMT deletion introduced by TALEN pair MsCOMT_T02.1
tctcacaaaaacctcatcaatcacaaccatgggttcaacaggtgaaactcaaataaccccaacccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgtggcgtctcttggctggttacaatatcctcacttgttcagttcgtactcaacaagatggaaaggttcagagactttatggtttggctactgttgctaa

SEQ ID NO: 11326 - DNA, 344 bp, Artificial
  MsCOMT deletion introduced by TALEN pair MsCOMT_T02.1
tctcacaaaaacctcatcaatcacaaccatgggttcaacaggtgaaactcaaataaccccaacccacatatcagatgaagaagcaaacctcttcgccatgcaactagcaagtgcttcagttcttcccatgattttaaaatcagctcttgaactaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 11327 - DNA, 358 bp, Artificial
  MsCOMT deletion introduced by TALEN pair MsCOMT_T02.1
tctcacaaaaacctcatcaatcacaaccatgggttcaacaggtgaaactcaaataacatcaacccacatatcagatgaagaagcaaacctcttcgccatgcaattagcaagtgcttcagttcttcccatgattttaaaatcagctcttgaacttgatctcttagactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11328 - DNA, 359 bp, Artificial
  MsCOMT deletion introduced by TALEN pair MsCOMT_T02.1
tctcacaaaaacctcatcaatcacaaccatgggttcaacaggtgaaactcaaataacatcaacccacatatcagatgaagaagcaaacctcttcgccatgcaattagcaagtgcttcagttcttcccatgattttaaaatcagctcttgaacttgatctcttagaaattaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 11329 - DNA, 359 bp, Artificial
  MsCOMT deletion introduced by TALEN pair MsCOMT_T02.1
tctcacaaaaacctcatcaatcacaaccatgggttcaacaggtgaaactcaaataacatcaacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11330 - DNA, 354 bp, Artificial
  MsCOMT deletion introduced by TALEN pair MsCOMT_T02.1
tctcacaaaaacctcatcaatcacaaccatgggttcaacaggtgaaactcaaataacactaacccacatatcagatgaagaagcaaacctcttcgccatgcaattagcaagtgcttcagttcttcccatgattttgaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggtactgttgctaa

SEQ ID NO: 11331 - DNA, 360 bp, Artificial
  MsCOMT deletion introduced by TALEN pair MsCOMT_T02.1
tctcacaaaaacctcatcaatcacaaccatgggttcaacaggtgaaactcaaataacactaacccacatatcagatgaagaagcaaacctcttcgccatgcaattagcaagtgcttcagttcttcccatgattttaaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11332 - DNA, 217 bp, Artificial
  MsCOMT deletion introduced by TALEN pair MsCOMT_T02.1
tctcacaaaaacctcatcaatcacaaccatgggttcaacaggtgaaactcaaataacacctacccacatatcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 11333 - DNA, 359 bp, Artificial
  MsCOMT deletion introduced by TALEN pair MsCOMT_T02.1
tctcacaaaaacctcatcaatcacaaccatgggttcaacaggtgaaactcaaataacacctacccacatatcagatgaagaagcaaacctcttcgccatgcaattagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11334 - DNA, 355 bp, Artificial
  MsCOMT deletion introduced by TALEN pair MsCOMT_T02.1
tctcacaaaaacctcatcaatcacaaccatgggttcaacaggtgaaactcaaataacacctacccacatatcagatgaagaagcaaacctcttcgccatgcaattagcaagtgcttcagttcttcccatgattttgaaatcagctcttgaacttgatctcttagaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 11335 - DNA, 346 bp, Artificial
  MsCOMT deletion introduced by TALEN pair MsCOMT_T02.1
tctcacaaaaacctcatcaatcacaaccatgggttcaacaggtgaaactcaaataacacctacccacatatcagatgaagaagcaaacctcttcgccatgcaactagcaagtgcttcagttcttcccatgattttaaaatcagctcttgaacttgatctctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11336 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccgacccacatatcagatgaagaagcaaacctcttcgccatgcaattagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11337 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccgacccacatatcagatgaagaagcaaacctcttcgccatgcaattagcaagtgcttcagttcttcccatgattttaaaatcagctcttgaacttgattaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 11338 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccgacccacatatcagatgaagaagcaaacctcttcgccatgcaactagcaagtgcttcagttcttcccatgattttgaaatcagctcttgaacttgatctcttagaaatcattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11339 - DNA, 458 bp, Artificial
  MsCOMT deletion introduced by TALEN pair MsCOMT_T02.1
tctcacaaaaacctcatcaatcacaaccatgggttcaacaggtgaaactcaaataacaccgacccacatatcagatgaagaagcaaacctcttcgccatgcaactagcaagtgcttcagttcttcccatgattttgaaatcagctcttgaacttgatctcttagaaatcagtccagcggctgttgccggtgctgtgccaggcccacggcttgaccccggagcaggtggtggccatcgccagccacgatggcggcaagcaggcgctggacagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11340 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccgacccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11341 - DNA, 347 bp, Artificial
  MsCOMT deletion introduced by TALEN pair MsCOMT_T02.1
tctcacaaaaacctcatcaatcacaaccatgggttcaacaggtgaaactcaaataacacccacccacatatcagatgaagaagcaaacctcttcgccatgcaactagcaagtgcttcagttcttcccatgattttgaaatcagctcttgaacttgatctcttagaaatggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11342 - DNA, 450 bp, Artificial
  MsCOMT deletion introduced by TALEN pair MsCOMT_T02.1
tctcacaaaaacctcatcaatcacaaccatgggttcaacaggtgaaactcaaataacacccacccacatatcagatgaagaagcaaacctcttcgccatgcaactagcaagtgcttcagttcttcccatgattttgaaatcagctcttgaacttgatctcttagaaatccaccacctgctggggggtcaagccgtgggcctggcacagcaccggcaacagccgctggaccgtctccagcgcctgcttgccgccatcgtggctgctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 11343 - DNA, 357 bp, Artificial
  MsCOMT deletion introduced by TALEN pair MsCOMT_T02.1
tctcacaaaaacctcatcaatcacaaccatgggttcaacaggtgaaactcaaataacacccacccacatatcagatgaagaagcaaacctcttcgccatgcaactagcaagtgcttcagttcttcccatgattttgaaatcagctcttgaacttgatctcttagaaaaaagctggacctggtgctcaaatttcacctattgaaattgcttctcagctaccaacaactaaccctgatgcaccagttatgttggaccgaatgttgcgtctcttggcgtgtgacaatatcctcacttgttcagttcgtactcaacaagatggaaaggttcagagacgttatggttgggctactgtgctaa

SEQ ID NO: 11344 - DNA, 217 bp, Artificial
  MsCOMT deletion introduced by TALEN pair MsCOMT_T02.1
tctcacaaaaacctcatcaatcacaaccatgggttcaacaggtgaaactcaaataacaccatcccacatatcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 11345 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccatcccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11346 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccatcccacatatcagatgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11347 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccatcccacatatcagatgaagaagcaaacctcttcgccatgcaattagcaagtgcttcagttcttcccatgattttaaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11348 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccatcccacatatcagatgaagaagcaaacctcttcgccatgcaattagcaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11349 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccatcccacatatcagatgaagaagcaaacctcttcgccatgcaactagcaagtgcttcagttcttcccatgattttgaaatcagctcttgaacttgatctcttagtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggtccagagactttatggtttggctactgttgctaa

SEQ ID NO: 11350 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccatcccacatatcagatgaagaagcaaacctcttcgccatgcaactagcaagtgcttcagttcttcccatgattttgaaatcagctcttgaacttgatctcttagaaatcattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11351 - DNA, 292 bp, Artificial
  MsCOMT deletion introduced by TALEN pair MsCOMT_T02.1
tctcacaaaaacctcatcaatcacaaccatgggttcaacaggtgaaactcaaataacaccatcccacatatcagatgaagaagcaaacctcttcgccatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11352 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccagcccacatatcagatgaagaagcaaacctcttcgccatgcaattagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11353 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccagcccacatatcagatgaagaagcaaacctcttcgccatgcaattagcaagtgcttcagttcttcccatgattttaaaatcagctcttgaacttgatctaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11354 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccagcccacatatcagatgaagaagcaaacctcttcgccatgcaactagcaagtgcttcagttcttcccatgattttgaaatcagctcttgaacttgatctcttagacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11355 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaccccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11356 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaccccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 11357 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaatccacatatcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11358 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaatccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11359 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaatccacatatcagatgaagaagcaaacctcttcgccatgcaattagcaagtgcttcagttcttcccatgattttaaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11360 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaatccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11361 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaatccacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11362 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaatccacatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11363 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaagccacatatcagatgaagaagcaaacctcttcgccatgcaactagcaagtgcttcagttcttcccatgattttgaaatcagctcttgaacttgatctcttaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11364 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaagccacatatcagatgaagaagcaaacctcttcgccatgcaactagcaagtgcttcagttcttcccatgattttgaaatcagctcttgaacttgatatattagtaaagctggacctggtgctcaaatttcacctattgaaattgcttctcagctcccaacaactaaccctgatgcaccagttatgttggaccgaatgtttcgtctcttggcttgttacaatatcctcactttttcagtccgtactcaacaagatggaaatgttcagagactttatggtttggctactgttgctaa

SEQ ID NO: 11365 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaactcacatatcagatgaagaagcaaacctcttcgccatgcaattagcaagtgcttcagttcttcccatgattttgaaatcagctcttgaacttgatctcttagaaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatagtttggctactgttgctaa

SEQ ID NO: 11366 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaactcacatatcagatgaagaagcaaacctcttcgccatgcaactagcaagtgcttcagttcttcccatgattttgaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtacccaacaagatggaaagattcagagactttatggtttggctactgttgctaa

SEQ ID NO: 11367 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacctacatatcagatgaagaagcaaacctcttcgccatgcaattagcaagtgcttcagttcttcccatgattttgaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttattgtctggataatgttgctaa

SEQ ID NO: 11368 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacctacatatcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11369 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacctacatatcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11370 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacctacatatcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11371 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacctacatatcagatgaagaagcaaacctcttcgccatgcaattagcaagtgcttcagttcttcccatgattttaaaatcagctcttgaacttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11372 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacctacatatcagatgaagaagcaaacctcttcgccatgcaattagcaagtgcttcagttcttcccatgattttaaaatcagctcttgaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11373 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacctacatatcagatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11374 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacctacatatcagatgaagaagcaaacctcttcgccatgcaactagcaagtgcttcagttcttcccatgattttgaaatcagctcttgaacttgatctcttagaaaaagctggacctggtgctcaaatttcacctattgaaattgcttctcagctaccaacaactaaccctgatgcaccagttatgttggaacgaatgttgcgtctcttggcttgttacaatatcctcacttgttcagttcgtactcaacaagatggaaaggttcagagactttatggtttggctactgttgctaa

SEQ ID NO: 11375 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaaccgatatataagataaagaagcaaacctcttctccataaaactagcaagtgcttcaattcttccaataattttgaaatcagctcttctacttgatctcttagatatggtgctcaaaattcatccattgaaattgcttctcagctaccaacaactaaccctgatgcaccagttatgttggaacgaatgttgcgtcccttggcttgttacaaaatcctcccttgttcagttcgtacccaacaagaaggaaagattccgagactttatggtttggctactgttgctaa

SEQ ID NO: 11376 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaaccgacatatcagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11377 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaaccgacatatcagatgaagaagcaaacctcttcgccatgcaactagcaagtgcttcagttcttcccatgattttgaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11378 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaaccgacatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11379 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaaccctcatatcagatgaagaagcaaacctcttcgccatgcaattagcaagtgcttcagttcttcccatgattttgaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11380 - DNA, 320 bp, Artificial
  MsCOMT deletion introduced by TALEN pair MsCOMT_T02.1
tctcacaaaaacctcatcaatcacaaccatgggttcaacaggtgaaactcaaataacaccaaccctcatatcagatgaagaagcaaacctcttcgccatgcaattagcaagtgcttcagttcttcccatgattttaaaatcagctcttgaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11381 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaaccctcatatcagatgaagaagcaaacctcttcgccatgcaattagcaagtgcttcagttcttcccatgattttaaaatcagctcttgaacttgatctcttagaaagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11382 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaaccctcatatcagatgaagaagcaaacctcttcgccatgcaactagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11383 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaaccctcatatcagatgaagaagcaaacctcttcgccatgcaactagcaagtgcttcagttcttcccatgattttgaaatcagctcttgaacttgatctctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11384 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccgcatatcagatgaagaagcaaacctcttcgccatgcaattagcaagtgcttcagttcttcccatgattttaaaatcagctcttgtctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11385 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccgcatatcagatgaagaagcaaacctcttcgccatgcaattagcaagtgcttcagttcttcccatgattttaaaatcagctcttgaacttgatctcttagaaatcaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 11386 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccgcatatcagatgaagaagcaaacctcttcgccatgcaactagcaagtgcttcagttcttcccatgattttgaaatcagctcttgaacttgatcttgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11387 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccgcatatcagatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11388 - DNA, 424 bp, Artificial
  MsCOMT deletion introduced by TALEN pair MsCOMT_T02.1
tctcacaaaaacctcatcaatcacaaccatgggttcaacaggtgaaactcaaataacaccaacccgcatatcagatgaagaagcaaacctcttcgccatgcaactagcaagtgcttcagttcttcccatgattttgaaatcagctcttgaacttgatctcttagaaatcagcaggtgttggccatcgccagcaatattggtgccaagcaggcgctggagacggtgcaggcgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11389 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccgcatatcagatgaagaagcaaacctcttcgccatgcaactagcaagtgcttcagttcttcccatgattttgaaatcagctcttgaacttgatctcttagaaatcaagctggacctggtgctcaaatttcacctgttcaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 11390 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccgcatatcagatgaagaagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11391 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccccatatcagatgaagaagcaaacctcttcgccatgcaactagcaagtgcttcagttcttcccatgattttgaaatcagctcttgagctaaagctggacctggtgctcaaatttcacctattgaaattgcttctcagctaccaacaactacccctgatgcaccagttatgttggaccgaatgttgcgtctcttggcttgttacaatatcctcacttgttcagttcgtactcaacaagatggaaagattcagagactttatgggttggctactgttgctaa

SEQ ID NO: 11392 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccccatataaaaggaagaggcaaacttcttccccatgcacctagcaagtgcttcagtccttcccatgattttgaaatcagctcttgaacttgatctcttagaaattgctaaatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11393 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccatatatcagatgaagaagcaaacctcttcgccatgcaattagcaagtgcttctgttcttcccatgattttaaaatcagctcttgaacttgatctcttagaagctggacctggtgctcaaatttcacctattgaaattgcttctcagctcccaacaactaaccctgatgcaccagttatgttggaccaaatgttgcgtctcttggcttgttacaatatcctcacttgttcagttcgtactcaacaagatggaaaagttcagagactttatggtttggctactgttgctaa

SEQ ID NO: 11394 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccatatatcagatgaagaagcaaacctcttcgccatgcaactagcaagtgcttcagttcttcccatgattttgaaatcagctcttgaacttgatctcttagaactaaagctggacctggtgctcaaatttcacctattgaaattgcttctcagctaccaacaactaaccctgatgcaccagttatgttggaccgaattttgcgtctcttggcttgttacaatatcctcacttgttcagttcgtactcaacaagatggaaaagttcagagactttatggtttggctactgttgctaa

SEQ ID NO: 11395 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccatatatcagatgaagaagcaaacctcttcgccatgcaactagcaagtgcttcagttcttcccatgattttgaaatcagctcttgaacttgatctcttagaaattggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11396 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccatatatcagatgaagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgactcttggcttgttacaatatcctcacttgttcagttcgtactcaacaagatggaaaggttcagagactttatggtttggctactgttgctaa

SEQ ID NO: 11397 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacttatcagatgaagaagcaaacctcttcgccatgcaactagcaagtgcttcagttcttcccatgattttgaaatcagctcttgaacttgatctcttagaaattgctaaatggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11398 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacttatcagatgaagaagcaaacctcttcgccatgcaactagcaagtgcttcagttcttcccatgattttgaaatcagctcttgaacttgatctcttagaaataaagctggacctggtgctcaaatttcacctgttcaaattgcttctcagctaccaacaactaaccctgatgcaccagttatgttggaccgaatgttgcgtctcttggcttgttacaatatcctctcttgttcagttcgtactcaacaagatggaaagtttcagagactttattgtttggctactgttgctaa

SEQ ID NO: 11399 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacttatcagatgaagaagcaaacctcttcgccatgcaactagcaagtgcttcagttcttcccatgattttgaaatcagctcttgaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11400 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacgttgcagatgaagacgcaaacctcatcgccttgcaatgagcaagtgcttctgttattcccttgattttaacatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11401 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacgtatcagatgaagaagcaaacctcttcgccatgcaattagcaagtgcttcagttcttcccatgattttgaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11402 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacgtatcagatgaagaagcaaacctcttcgccatgcaattagcaagtgcttcagttcttcccatgattttaaaatcagctcttgaacttgatctcttgacctggtgctcaaatttcacctgttcaaattgcttctcagcttccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 11403 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatttcagatgaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgcgaa

SEQ ID NO: 11404 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatttcagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11405 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatgtcagatgaagaagcaaacctcttcgccatgcaattagcaagtgcttcagttcttcccatgattttaaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11406 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatgtcagatgaagaagcaaacctcttcgccatgcaattagcaagtgcttcagttcttcccatgattttaaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11407 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatgtcagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11408 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatctcagatgaagaagcaaacctcttcgccatgcaactagcaagtgcttcagttcttcccatgattttgaaatcagctcttgaacttgatctcttagaaatggacctggtgctcaaatttcacctattgaaattgcttctcagctaccaacaactaaccctgatgcaccagttatgttggaccgaatgttgcgtcgcttggcttgttacaagatcctcacttgttcagttcgtactcaacaagatggaaaggttcagagactttatggtttggctactgttgctaa

SEQ ID NO: 11409 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatcagatgaagaagccaacctcttcgccatgcaattagcaagtgcttcagttcttcccatgattttaaaatcagctcttgaacttgatctcttagaaatctgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11410 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatattagatgaagaagcaaacctcttcgccatgcaattagcaagtgcttcagttcttcccatgattttaaaatcagctcttgaacttgatctcttagaaataagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 11411 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatattagatgaagaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11412 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatattagatgaagaagcaaacctcttcgccatgcaattagcaagtgcttcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11413 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatattagatgaagaagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11414 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatattagatgaagaagcaaacctcttcgccatgcaactagcaagtgcttcagttcttcccatgattttgaaatcagctcttgaacttgatctctgtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11415 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatgagatgaagaagcaaacctcttcgccatgcaattagcaagtgcttcagttcttcccatgattttaaaatcagctcttgaacttgatctcttagaaatcactggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 11416 - DNA, 333 bp, Artificial
  MsCOMT deletion introduced by TALEN pair MsCOMT_T02.1
tctcacaaaaacctcatcaatcacaaccatgggttcaacaggtgaaactcaaataacaccaacccacatatgagaagaagaagcaaacctcttcgccatgcaactagcaagtgcttcagttcttcccatgattttgaaatctaaagctggacctggtgctcaaatttcacctattgaaattgcttctcagctaccaacaactaaccctgatgcaccagttatgttggaccgaatgttgcggctcttggcttgttacaatatcctcacttgttaagttcgtaatcaacaagatggaaagattcagagactttatggtttggctactgttgctaa

SEQ ID NO: 11417 - DNA, 337 bp, Artificial
  MsCOMT deletion introduced by TALEN pair MsCOMT_T02.1
tctcacaaaaacctcatcaatcacaaccatgggttcaacaggtgaaactcaaataacaccaacccacatatctgatgaagaagcaaacctcttcgccatgcaattagcaagtgcttcagttcttcccatgattttaaaatcagctcttgactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11418 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatctgatgaagaagcaaacctcttcgccatgcaattagcaagtgcttcagttcttcccatgattttaaaatcagctcttgaacttgatctcttagaaatcatctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 11419 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatctgatgaagaagcaaacctcttcgccatgcaattagcaagtgcttcagttcttcccatgattttaaaatcagctcttgaacttgatctcttagaaatcagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11420 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatctgatgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11421 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatctgatgaagaagcaaacctcttcgccatgcaactagcaagtgcttcagttcttcccatgattttgaaatcagctcttgaacttgatctcttagaaataagctggacctggtgcccaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11422 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatctgatgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11423 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatctgatgaagaagcaaacctcttcgccatgcaactagcaagtgcttcagttcttcccatgattttgaaatcagctcttgaacttgatctcttagaaacactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11424 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatctgatgaagaagcaaacctcttcgccatgcaactagcaagtgcttcagttcttcccatgattttaaaatcagctcttgaacttgatctcttagaaatcattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11425 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcggatgaagaagcaaacctcttcgccatgcaattagcaagtgcttcagttcttcccatgattttgaaatcagctcttgaacttgatctcttagactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11426 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcggatgaagaagcaaacctcttcgccatgcaattagcaagtgcttcagttcttcccatgattttgaaatcagctcttgaacttgatctcttagaaatcattgctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 11427 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcggatgaagaagcaaacctcttcgccatgcaattagcaagtgcttcagttcttcccatgattttaaaatcagctcttgaacttgatctcttagaaattggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11428 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcggatgaagaagcaaacctcttcgccatgcaattagcaagtgcttcagttcttcccatgattttaaaatcagctcttgaacttgatctcttagaaatcaaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 11429 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcggatgaagaagcaaacctcttcgccatgcaattagcaagtacttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11430 - DNA, 293 bp, Artificial
  MsCOMT deletion introduced by TALEN pair MsCOMT_T02.1
tctcacaaaaacctcatcaatcacaaccatgggttcaacaggtgaaactcaaataacaccaacccacatatcggatgaagaagcaaacctcttcgccatgcaactagcaagtgcttcagttcttcccatgattttgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11431 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcggatgaagaagcaaacctcttcgccatgcaactagcaagtgcttcagttcttcccatgattttgaaatcagctcttgaacttgatctcttagaaatcagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11432 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcggatgaagaagcaaacctcttcgccatgcaactagcaagtgcttcagttcttcccatgattttgaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11433 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcggatgaagaagcaaacctcttcgccatgcaactagcaagtgcttcagttcttcccatgattttgaaatcagctcttgaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11434 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatccgatgaagaagcaaacctcttcgccatgcaactagcaagtgcttcagttcttcccatgattttgaaatcagctcttgaacttgatctcttagagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11435 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcatatgaagaagcaaacctcttcgccatgcaattatcaagtgcttcagttcttcccatgattttaaaatcagctcttgaacttgatctcttagagcttgacctgttgctcaaatttcacctattgacattgcttctcagttcccaacaactaaccctgatgcaccagttatgttggaccgagtgttgcgtctcttggcatgttacaatatccacccttgttcacttcgtactaaacaagatggaaagattcagagactttatggtttggctactgttgcaaa

SEQ ID NO: 11436 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcatatgaagaagcaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11437 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcatatgaagaagcaaacctcttcgccatgcaattagcaagtgcttcagttcttcccatgattttaaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagtttcagagactttatggtttggctactgttgctaa

SEQ ID NO: 11438 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagttgaagaagcaaacctcttcgccatgcaactagcaagtgcttcagttcttcccatgattttgaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11439 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagttgaagaagcaaacctcttcgccatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11440 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcaggtgaagaagcaaacctcttcgccatgcaattagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11441 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcaggtgaagaagcaaacctcttcgccatgcaattagcaagtgcttcagttcttcccatgattttaaaatcagctcttgaacttgatctcttagaaatcatggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 11442 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcaggtgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11443 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcaggtgaagaaacaaacctcttcgccatggaattagcaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgtgcagttcgtactcaacaagatggaaaggttcagagactttatggtttggctactgttgctaa

SEQ ID NO: 11444 - DNA, 217 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagcttccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 11445 - DNA, 217 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagcttccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 11446 - DNA, 217 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagcttccaacaactaaccctgatgcaccagttatgttggaccgaatgttgcgtctcttggcttgttacaatatcctcacttgttcagttcgtactcaacaagatggagagattcagagactttatggtttggctactgttgctaa

SEQ ID NO: 11447 - DNA, 217 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11448 - DNA, 217 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagcttccaacaactaaccctgatgcaccagttatgttggaccgaatgttgcgtctcttggcttgttacaatatcctcacttgttcagttcgtactcaacaagatggaaagattcagagactttatggtttggctactgtttctaa

SEQ ID NO: 11449 - DNA, 217 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11450 - DNA, 216 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagcttccaacaactaaccctgatgcaccagttatgttggaccgaatgttgcgtctcttggcttgttacaatatcctcacttgttcagttcgtactcaacaagatggaaaagttcagagactttatggtttggtactgttgctaa

SEQ ID NO: 11451 - DNA, 217 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagcttccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11452 - DNA, 216 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagcttccaacaactaaccctgatgcaccagttatgttggaccgaatgttgcgtctcttggcttgttacaatatcctcacttgttcagttcgtactcaacaagatgaaaggttcagagactttatggtttggctactgttgctaa

SEQ ID NO: 11453 - DNA, 217 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagcttccaacaactaaccctgatgcaccagtcatgttggaccgaatgttgcgtctcttggcttgttacaatatcctcacttgttctgttcgtactcaacaagatggaaaggttcagagactttatggtttggctactgtttctaa

SEQ ID NO: 11454 - DNA, 217 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 11455 - DNA, 217 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagcttccaacaactaaccctgatgcaccagtcatgttggaccgaatgttgcgtctcttggcttgttacaatatcctcacttgttctgttcgtactcaacaagatggaaaggttcagagaccttatggtttggctactgttgctaa

SEQ ID NO: 11456 - DNA, 217 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 11457 - DNA, 217 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagcttccaacaactaaccctgatgcaccagtcatgttggaccgaatgttgcgtctcttggcttgttacaatatcctcacttgttctgttcgtacccaacaagatggaaaggttcagagactttatggtttggctactgttgctaa

SEQ ID NO: 11458 - DNA, 217 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagcttccaacaactaaccctgatgcaccagtcatgttggaccgaatgttgcgtctcttggcttgttacaatatcctcacttgttcagttcgtactcgacaagatggaaaggttcagagactttatggtttggctactgttgctaa

SEQ ID NO: 11459 - DNA, 217 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 11460 - DNA, 217 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagcttccaacaactaaccctgatgcaccagtcatgttggaccgaatgttgcgtctcttggcttgttacaatatcctcacttgttcagttcgtactcaacaagatggaaagattcagagcctttatggtttggctactgttgctaa

SEQ ID NO: 11461 - DNA, 217 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 11462 - DNA, 217 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 11463 - DNA, 216 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagcttccaacaactaaccctgatgcaccagtcatgttggaccgaatgttgcgtctcttggcttgttacaatatcctcacttgttcagttcgtactcaacaagatggaaaagttcagagactttatggtttgctactgttgctaa

SEQ ID NO: 11464 - DNA, 217 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagcttccaacaactaaccctgatgcaccagtcatgttggaccgaatgttgcgtctcttggcttgttacaatatcctcacttgttcagttcatactcaacaagatggaaaggttcagagactttatggtttggctactgttgctaa

SEQ ID NO: 11465 - DNA, 217 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagcttccaacaactaaccctgatgcaccagtcatgttggaccgaatgttgcgtctcttggcttgctacaatatcctcacttgttctgttcgtactcaacaagatggaaagattcagagactttatggtttggctactgttgctaa

SEQ ID NO: 11466 - DNA, 217 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagcttccaacaactaaccctgatgcaccagtcatgtcggaccgaatgttgcgtctcttggcttgttacaatatcctcacttgttctgttcgtactcaacaagatggaaaggttcagagactttatggtttggctactgttgctaa

SEQ ID NO: 11467 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagctgaagaagcaaacctcttcgccatgcaactagcaagtgcttcagttcttcccatgcttttaaaatcagctcttgaacttgatctcttagaaatcagctggacctggtgctcaaatttcacctattgaaatttcttctcagctcccaacaactaaccctgatgcaccagttatgttggaccgaatgttgcgtctcttggcttgttacaatagcctcacttgttcagttcgtactcaacaagatggaaagattcagagactttatggtttggctactgttgctaa

SEQ ID NO: 11468 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagctgaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11469 - DNA, 217 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11470 - DNA, 217 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11471 - DNA, 217 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11472 - DNA, 217 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11473 - DNA, 293 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagattaagaagcaaacctcttcgccatgcaattagcaagtgcttcagttcttcccatgattttgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 11474 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagattaagaagcaaacctcttcgccatgcaattagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtacccaacaagatggaaaggttcagagactttatggtttggctactgttgctaa

SEQ ID NO: 11475 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagattaagaagcaaacctcttcgccatgcaattagcaagtgcttcagttcttcccatgattttaaaatcagctcttgaacttgatcttggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11476 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagattaagaagcaaacctcttcgccatgcaattagcaagtgcttcagttcttcccatgattttaaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11477 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagattaagaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11478 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagattaagaagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcactttttcatttcgtactcaacaagatggaaaggttcagagactttatggtttggctactgttgctaa

SEQ ID NO: 11479 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagattaagaagcaaacctcttcgccatgcaactagcaagtgcttcagttcttcccatgattttgaaatcagctcttgaacttgatctcttagaaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactggtgctaa

SEQ ID NO: 11480 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgtagaagcaaacctcttcgccatgcaactagcaagtgcttcagttcttcccatgattttgaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11481 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatggagaagcaaacctcttcgccatgcaattagcaagtgcttcagttcttcccatgattttaaaatcggctcttgaacttgatctcttagaaatcagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11482 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatggagaagcaaacctcttcgccatgcaattagcaagtgcttcagttcttcccatgattttaaaatcagctcttgaacttgatctcttagaaatctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 11483 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatggagaagcaaacctcttcgccatgcaactagcaagtgcttcagttcttcccatgattttgaaatcagctcttgaacttgatctcttagaatcactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11484 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatggagaagcaaacctcttcgccatgcaactagcaagtgcttcagttcttcccatgattttgaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctctgttgctaa

SEQ ID NO: 11485 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatggagaagcaaacctcttcgccatgcaactagcaagtgcttcagttcttcccatgattttgaaatcagctcttgaacttgatctcttagaaatctacagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11486 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatggagaagcaaacctcttcgccatgcaactagcaagtgcttcagttcttcccatgattttgaaatcagctcttgaacttgatctcttagaaatcattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11487 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatggagaagcaaacctcttcgccatgcaactagcaagtgcttcagttcttcccatgattttgaaatcagctcttgaacttgatctcttagaaatcatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11488 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatggagaagcaaacctcttcgccatgcaactagcaagtgcttcagttcttcccatgattttgaaatcagctcttgaacttgatctcttagaaatcatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11489 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatggagaagcaaacctcttcgccatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11490 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgcagaagcaaacctcttcgccatgcaattagcaagtgcttcagttcttcccatgattttaaaatcagctcttgaacttgatctcttagaagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtgtggatactgttgctaa

SEQ ID NO: 11491 - DNA, 418 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgcagaagcaaacctcttcgccatgcaactagcaagtgcttcagttcttcccatgattttgaaatcagctcttgaacttgatctcttagaaatcaagccgtgggcctggcacagcaccggcaacagccgctggaccgtctacatcgcctgctaaagccggacctggtgctcaaatttcaccgattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11492 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgatgaagcgaacctcttcgccatgcaactagcaagtgcttcagttcttcccatgattttaaaatcagctcttgaacttgatctcttagaaaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11493 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgatgaagcaaacctcttcgccatgcaattagcaagtgcttcagttcttcccatgattttgaaatcagctcttgaacttgatctcttagaaatcgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11494 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgatgaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11495 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgatgaagcaaacctcttcgccatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11496 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgatgaagcaaacctcttcgccatgcaattagcaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11497 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgatgaagcaaacctcttcgccatgcaactaacaagtgcttcagttcttcccatgattttgaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11498 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaggaagcaaacctcttcgccatgcaattagcaagtgcttcagttcttcccatgattttgaaatcagctcttgaacttgatctcttagaaatcattaaagctggacctggtgctcaaatttcacctattgaaatcgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 11499 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaggaagcaaacctcttcgccatgcaattagcaagtgcttcagttcttcccatgattttgaaatcagctcttgaacttgatctcttagaaatagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11500 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaggaagcaaacctcttcgccatgcaattagcaagtgcttcagttcttcccatgattttaaaatcagctcttgaacttgatctcttagaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11501 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaggaagcaaacctcttcgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11502 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaggaagcaaacctcttcgccatgcaattagcaagtgcttcagttcttcccatgattttaaaatcagctcttgaacttgatctcttagaaataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 11503 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaggaagcaaacctcttcgccatgcaattagcaagtgcttcagttcttcccatgattttaaaatcagctcttgaacttgatctcttagaaacataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11504 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaggaagcaaacctcttcgccatgcaactagcaagtgcttcagttcttcccatgattttgaaatcagctcttgaacttggtctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11505 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaggaagcaaacctcttcgccatgcaactagcaagtgcttcagttcttcccatgattttgaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagcctttatggtttggctactgttgctaa

SEQ ID NO: 11506 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaggaagcaaacctcttcgccatgcaactagcaagtgcttcagttcttcccatgattttgaaatcagctcttgaacttgatctcttagaaatcattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11507 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaggaagcaaacctcttcgccatgcaactagcaagtgcttcagttcttcccatgattttgaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11508 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgacgaagcaaacctcttcgccatgcaactagcaagtgcttcagttcttcccatgattttgaaatcagctcttgaacttgatctcttagaaatcattggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11509 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgacgaagcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11510 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaataagcaaacctcttcgccatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11511 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaataagcaaacctcttcgccatgcaattagcaagtgcttcagttcttcccatgattttaaaatcagctcttgaacttgatctcttagaaatcactaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11512 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaataagcaaacctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatcttgcgtctcttggcttgttacaatatcctcacttgttcagttcgtactcaacaagatggaaaggttcagagactttatggtttggctactgttgctaa

SEQ ID NO: 11513 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagtagcaaacctcttcgccatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11514 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagtagcaaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11515 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagtagcaaacctcttcgccatgcaactagcaagtgcttcagttcttcccatgattttgaaatcagctcttgaacttgatctcttagaaataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagcctttatggtttggctactgttgctaa

SEQ ID NO: 11516 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagtagcaaacctcttcgccatgcaactagcaagtgcttcagttcttcccatgattttgaaatcagctcttgaacttgatctcttagaaataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 11517 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagtagcaaacctcttcgccatacaactagcaagtgcttcagttcttccaatgtttttgaaatcagctcttgaacttgatctcttagaaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11518 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaaggagcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11519 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaaggagcaaacctcttagccatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11520 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagcagcaaacctcttcgccatgcaattagcaagtgcttcagttcttcccatgattttaaaatcagctcttgaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactgtatggtttggctactgttgctaa

SEQ ID NO: 11521 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagcagcaaacctcttcgccatgcaattagcaagtgcttcagttcttcccatgattttaaaatcagctcttgaacttgatctcttagaaataagctggacctggtgctcaaatttcacctattgaaattgcttctcagctcccaacaactaaccctgatgcaccagttatgttggaccgaatgttacgtctctaggcatgttacaatgtcctcacttgttcagttcgtactcaacaatattgaaaggttcagagtctttatggtttggctactgttgctaa

SEQ ID NO: 11522 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagcagcaaacctcttcgccatgcaattagcaagtgcttcagttcttcccatgattttaaaatcagctcttgaacttgatctctaaagctggacctggtgctcaaatttcacctattgaaattgcttctcagctaccaacaactaaccctgatgcaccagttatgttgtaccgaatgttgcgtctcgtggctggttacaatatcttcacgtggtcagttcgttctcaacaagatggaaaggttcagagactttatggtttggggactgttgctaa

SEQ ID NO: 11523 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagcagcaaacctcttcgccatgcaactagcaagtgcttcagttcttcccatgattttgaaatcagctcttcaacttgatctcttagaaaactaaagctggacctggtgctcaaatttcacctattgaaattgcttctcagctaccaacaactaaccctgatgcaccagttatgttggaccgaatgttgcgtctcgtggcttgttacaatatcctctcttgttcagttcgtactcaacaagatggaaaggttcagagactttatggtttggctactgttgctaa

SEQ ID NO: 11524 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagcacacctcttcgccatgcaattagcaagtgcttcagttcttcccatgattttaaaatcagctcttgaacttgatctcttagaaatcatggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattccgagactttatggtttggctactgttgctaa

SEQ ID NO: 11525 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagatgcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11526 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaggcaaacctcttcgccatgcaactagcaagtgcttcagttcttcccatgattttgaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11527 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaggcaaacctcttcgccatgcaactagcaagtgcttcagttcttcccatgattttgaaatcagctcttgaacttgatctcttagaaatagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11528 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaggcaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11529 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaatcaaacctcttcgccatgcaattagcaagtgcttcagttcttcccatgattttaaaatcagctcttgaacttgatctcttagaaactaaagctggacctggtgctcaaatttcacctattgaaattgcttctcagctaccaacaactaaccctgatgcaccagttatgttggaccgaatgtttcgtctcttggcttgttacaatatcctcacgtgttcagttcgtactcaacaagatggaaagattcagagactttatggtttggctactgttgctaa

SEQ ID NO: 11530 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaatcaaacctcttcgccatgcaattagcaagggcttcagttcttcccatgattttaaaatcagctcttgaacttgatctcttagaaatcaagctggacctggtgctcaaatttcacctattgaaattgcttctcagctaccaccaactaaccctgatgcaccagttatgttggaccgaatgttgcgtctcttcgcttctcacaatatcctcccttcttcacttcgtcctcaacaagatagaaaggttcagagcctttagggtttggctactgttgctaa

SEQ ID NO: 11531 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaatcaaacctcttcgccatgcaactagcaagtgcttcagttcttcccatgattttgaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11532 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaatcaaacctcttcgccatgcaactagcaagtgcttcagttcttcccatgattttgaaatcagctcttgaacttgatctcttagaagctggacctggtgctcaaatttcacctattgaaattgcttctcagctaccaacaactaaccctgatgcaccagttatgttggaccgaatgttgcgtctctcggcttgttacaatatcctcacttgttcagttcgtactcaacaagatggaaaggttcagagactttatggtttggctactgttgctaa

SEQ ID NO: 11533 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaatcaaacctcttcgccatgcaactagcaagtgcttcagttcttcccatgattttgaaatcagctcttgaacttgatctcttagaaattgaacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11534 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaatcaaacctcttcgccatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcacttcgtactcaacaagatggaaaggttcaaagactttatggtttggctactgttgctaa

SEQ ID NO: 11535 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaatcaaacctcttcgccatgcaactagcaagtgcttcagttcttcccatgattttgaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11536 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagtaaacctcttcgccatgcaattagcaagtgcttcagttcttcccatgattttgaaatcagctcttgaacttgatctcttagaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11537 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagtaaacctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11538 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagtaaacctcttcgccatgcaattagcaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11539 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagtaaacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11540 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagtaaacctcttcgccatgcaactagcaagtgcttcagttcttcccatgattttgaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11541 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagtaaacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11542 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagtaaacctcttcgccatgcaactagcaagtgcttcagttcttcccatgattttgaaatcagctcttgaacttgatctcttaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11543 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagtaaacctcttcgccatgcaactagcaagtgcttcagttcttcccatgattttgaaatcagctcttgaacttgatctcactaaagctggacctggtgctcaaatttcacctattgaaattgcttctcagctaccaacaactaaccctgatgcaccagttatgttggaccgaatgttgcgtctcttggcttgttacaatatcctcccttgttcatttcgtactcaacaagatggaaaggttcagagactttatggtttggctactgttgctaa

SEQ ID NO: 11544 - DNA, 331 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagtaaacctcttcgccatgcaactagcaagtgcttcagttcttcccatgattttgaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11545 - DNA, 418 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcgaacctcttcgccatgcaattagcaagtgcttcagttcttcccatgattttgaaatcagctcttgaacttgatctcttagaaatcatggccatcgccagcaatggcggcggcaggccggcgctggagagcattgttgcccagtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11546 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcgaacctcttcgccatgcaattagcaagtgcttcagttcttcccatgattttaaaatcagctcttgaacttgatctcttagaaatttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11547 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcgaacctcttcgccatgcaattagcaagtgcttcagttcttcccatgattttaaaatcagctcttgaacttgatctcttagaaataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 11548 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcgaacctcttcgccatgcaattagcaagtgcttcagttcttcccatgattttaaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11549 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcgaacctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11550 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcgaacctcttcgccatgcaactagcaagtgcttcagttcttcccatgattttgaaatcagctcttgaacttgatctcttagaaatcagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11551 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcatacctcttcgccatgcaattagcaagtgcttcagttcttcccatgattttaaaatcagctcttgaacttgataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11552 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcatacctcttcgccatgcaattagcaagtgcttcagttcttcccatgattttaaaatcagctcttgaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11553 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcatacctcttcgccatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11554 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcatacctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11555 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcagacctcttcgccatgcaattagcaagtgcttcagttcttcccatgattttaaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11556 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcagacctcttcgccatgcaattagcaagtgcttcagttcttcccatgattttaaaatcagctcttgaacttgatctcttagaaatcaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtcctcaacaagatggaaaggttaagagcctttatggtttggctactgttgctaa

SEQ ID NO: 11557 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcagacctcttcgccatgcaattagcaagtgcttcagttcttcccatgattttaaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11558 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcacacctcttcgccatgcaattagcaagtgcttcagttcttcccatgattttaaaatcagctcttgaacttgaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11559 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaatcctcttcgccatgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11560 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaatcctcttcgccatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctacgttgctaa

SEQ ID NO: 11561 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaagcctcttcgccatgcaattagcaagtgcttcagttcttcccatgattttgaaatcagctcttgaacttgatctcttagaaatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 11562 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaagcctcttcgccatgcaattagcaagtgcttcagttcttcccatgattttaaaatcagctcttgaacttgatctcttagaaatttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11563 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaagcctcttcgccatgcaactagcaagtgcttcagttcttcccatgattttgaaatcagctcttgaacttgatctcttggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11564 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaagcctcttcgccatgcaactagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11565 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaacctcttcgccatgcaattagcaagtgcttcagttcttcccatgattttgaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11566 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaacctcttcgccatgcaattagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11567 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaacctcttcgccatgcaactagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11568 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaccctcttcgccatgcaattagcaagtgcttcagttcttcccatgattttgaaatcagctcttgaacttgatctcttagaaatctgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11569 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaccctcttcgccatgcaattagcaagtgcttcagttcttcccatgattttaaaatcagctcttgaacttgatctcttataaagctggacctggtgctcaaatttcacctattgaaattgcttctcagctaccaacaactaaccctgatgcaccagttatgttggaccgaatgttgcgtctcttggcttgttacaatatcctcacttgtgcagttcgtactcaacaagatggaaagattcagagactttatggtttggctactgttgctaa

SEQ ID NO: 11570 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaccctcttcgccatgcaattagcaagtgcttcagttcttcccatgattttaaaatcagctcttgaacttgatctcttagaaatcagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11571 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaccctcttcgccatgcaattagcaagtgcttcagttcttcccatgattttaaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11572 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaccctcttcgccatgcaattagcaagtgcttcagttcttcccatgattttaaaatcagctcttgaacttgatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11573 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaatctcttcgccatgtaattagcaagtgcttcagttcttcccatgattttaaaatcagctcttgaacttgatctcttagaaactaaagctggacctggtgctcaaatttcacctattgaaattgcttctcagctcccaacaactaaccctgatgcacccgttatgttggaccgaatgttgcgtctcttggcttgttacaatatactcccttgttcagttcgtactcaacaagattgaaacgttcagagactttatggtttggctactgttgctaa

SEQ ID NO: 11574 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaatctcttcgccatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11575 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaatctcttcgccatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11576 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaatctcttcgccatgcaactagcaagtgcttcagttcttcccatgattttgaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11577 - DNA, 290 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaatctcttcgccatgcaactagcaagtgcttcagttcttcacctattgaaattgcttctcagctcccaacaactaaccctgatgcaccagttatgttggaccaaatgttgcgtctcttggcttgttacaatatcctcacttgttcagttcgtactcaacaagatggaaagattcagagactttatggtttggctcctgttgctaa

SEQ ID NO: 11578 - DNA, 333 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaagctcttcgccatgcaattagcaagtgcttcagttcttcccatgattttgaaatcagctcttgaacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11579 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaagctcttcgccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11580 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacttcttcgccatgcaattagcaagtgcttcagttcttcccatgattttgaaatcagctcttgaacttgatctcttagaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11581 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacttcttcgccatgcaattagcaagtgcttcagttcttcccatgattttgaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11582 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacttcttcgccatgcaactagcaagtgcttcagttcttcccatgattttgaaatcagctcttgaacttgatctcttactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11583 - DNA, 234 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaaccttttcgccatgcaattagcaagtgcttcagttatgttggaccgaatgttgcgtctcttggcttgttacaatatcctcacttgttcagttcgtactcaacaagatggaaaggttcagagactttatggtttggctactgttgttaa

SEQ ID NO: 11584 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctgttcgccatgcaattagcaagtgcttcagttcttcccatgattttaaaatcagctcttgaacttgatctcttagaaattaaagctggacctggtgctcaaatttcatctgttcaaattgcttctcagcttccaacaactaatcgtgatgcaccagtcatgttggaccgaatgtggcgtctcttgttttgttacaatatcctcacttgttctgttcgtactcaacaagatggaaaggttcagagactttatggtctggctactgttgctaa

SEQ ID NO: 11585 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctgttcgccatgcaactagcaagtgcttcagttcttcccatgattttgaaatcagctcttgaacttgatcttgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11586 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctgttcgccatgcaactagcaagtgcttcagttcttcccatgattttgaaatcagctcttgaacttgatctcttagaaataaagctggacctggtgctcaaatttcacctattgaaattgcttctcagctaccaacaactagccctgattccccagttatgttggaccgaatgttgcctctcttggcttgttacaatatcctcacttgttcagttcgtactcaacaagatggaaaggttcagagacattatggtttagctactgttgctaa

SEQ ID NO: 11587 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctgttcgccatgcaactagcaagtgcttcagttcttcccatgattttaaaatcagctcttgaacttgatctcttagaaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11588 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctctttgccatgcaattagcaagtgcttcagttcttcccatgattttaaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11589 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctctttgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11590 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctctttgccatgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11591 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctctttgccatgcaattagcaagtgcttcagttcttcccatgattttaaaatcagctcttgaacttgatctcttagaaatcataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11592 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctctttgccatgcaattagcaagtgcttcagttcttcccatgattttaaaatcagctcttgaacttgatctcttagaaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 11593 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctctttgccatgcaattagcaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11594 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctctttgccatgcaactagcaagtgcttcagttcttcccatgattttgaaatcagctcttgaacttgatctcttagaaatctaaagctggacccggtgctcaaatttcacctattgaaattgcttctcagctaccaacaactaaccctgatgcaccagttatgttggaccgaatgttgcgtctcttggcttgttacaatatcctcactttttcagttcgtactcaacaagatggaaaggttcagagactttatggtttggctactgttgctaa

SEQ ID NO: 11595 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctctttgccatgcaactagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11596 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttgcccaggaaataaccaagtgcttcagttcttcccatgattttaaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11597 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttctccattcaattatcaattgcttcagttcttcccattattttgaaatcatctcttgaacttgatctcttagaaatcaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11598 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttctccatgcaattagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 11599 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttctccatgcaattagcaagtgcttcagttcttcccatgattttaaaatcagctcttgaacttgatctcttagaaatcactaaagctggacctggtgctcaaatttcacctattgaaattgcttctcagctcccaacaactaaccctgatgcaccagttatgttggaccgaatgttgcgtctcttggcttgttacaatatcctcacttgttcatttcgtactcaacaagatggaaaggttcagagactttatggtttggctactgttgctaa

SEQ ID NO: 11600 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttctccatgcaattagcaagtgcttcagttcttcccatgattttaaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11601 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttctccatgcaattagcaagtgcttcagttcttcccatgattttaaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11602 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttctccatgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11603 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttctccatgcaattagcaagtgcttcagttcttcccatgattttaaaatcagctcttgaacttgatctcttagaaactaaagctggacctggtgctcaaatttcacctattgaaattgcttctcagctaccaacaactaaccctgatgcaccagttatgttgtaccgaattttgcgtctcttggcttgttacaatatcctcacttgttcagttcgtactcaacaagatggaaaggttcagagactttatggtttcgctactgttgctaa

SEQ ID NO: 11604 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttctccatgcaactagcaagtgcttcagttcttcccatgattttgaaatcagctcttgaacttgatctctttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11605 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttctccatgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11606 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttctccatgcaactagcaagtgcttcagttcttcccatgattttaaaatcagctcttgaacttgatctcttagaaaataaagctggacctggtgctcaaatttcacctattgaaattgcttcccagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11607 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgtcatgcaattagcaagtgcttcagttcttcccatgattttgaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggttggctactgttgctaa

SEQ ID NO: 11608 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgtcatgcaattagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11609 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgtcatgcaattagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11610 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgtcatgcaattagcaagtgcttcagttcttcccatgattttaaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11611 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgtcatgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11612 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgtcatgcaattagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttgactactgttgctaa

SEQ ID NO: 11613 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgtcatgcaattagcaagtgcttcagttcttcccatgattttaaaatcagctcttgaacttgatctcttagaaatcgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11614 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgtcatgcaattagcaagtgcttcagttcttcccatgattttaaaatcagctcttgaacttgatctcttagaaatcctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11615 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgtcatgcaattagcaagtgcttcagttcttcccatgattttaaaatcagctcttgaacttgatctcttagaaatcattaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 11616 - DNA, 449 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgtcatgcaattagcaagtgcttcagttcttcccatgattttaaaatcagctcttgaacttgatctcttagaaatcatggcttgttatgactgtttttttggggtacagtctatgcctcgggcatccaagcagcaagcgcgttacgccgtgggtcgatgtttgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11617 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgtcatgcaattagcaagtgcttcagttcttcccatgattttaaaatcagctcttgaacttgatctcttagaaatcatctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11618 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgtcatgcaattagcaagtgcttcagttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11619 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgtcatgcaattagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11620 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgtcatgcaattagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11621 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgtcatgcaattagcaagtgcttcagttcttcccatgattttaaaatcagctcttgaacttgatcctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11622 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgtcatgcaactagcaagtgcttcagttcttcccatgattttgaaatcagctcttgaacttgatctcttagataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 11623 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgtcatgcaactagcaagtgcttcagttcttcccatgattttgaaatcagctcttgaacttgatctcttagataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11624 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgtcatgcaactagcaagtgcttcagttcttcccatgattttgaaatcagctcttgaacttgatctcttagaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11625 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgtcatgcaactagcaagtgcttcagttcttcccatgattttgaaatcagctcttgaacttgatctcttagaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 11626 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgtcatgcaactagcaagtgcttcagttcttcccatgattttgaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11627 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgtcatgcaactagcaagtgcttcagttcttcccatgattttgaaatcagctcttgaacttgatctcttagaactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11628 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgtcatgcaactagcaagtgcttcagttcttcccatgattttgaaatcagctcttgaacttgatctcttagaaattctaaagctggacctggtgctcaaatttcacctattgaaattgcttctcagctaccaacaactaaccctgatgcaccagttatgttggaccgaatgttgcgtctcttggcttgttacaatatcctcacttgttcggttcgtactcaacaagatggaaaagttcagagactttatggtttggctactgttgctaa

SEQ ID NO: 11629 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgtcatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11630 - DNA, 367 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgtcatgcaactagcaagtgcttcagttcttcccatgattttgaaatcagctcttgaacttgatctcttagaaatcatttgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11631 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgtcatgcaactagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 11632 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgtcatgcaactagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11633 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgtcatgcaactagcaagtgcttcagttcttcccatgattttgaaatcagctcttgaacttgatctcttagaaatagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 11634 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgtcatgcaactagcaagtgcttcagttcttcccatgattttgaaatcagctcttgaacttgatctcttagaaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11635 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgtcatgcaactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11636 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgtcatgcaactagcaagtgcttcagttcttcccatgattttgaaatcagctcttgaacttgatctcttagaaataaagctggacctggtgctcaaatttcacctattaaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11637 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgtcatgcaactagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11638 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgtcatgcaactagcaagtgcttcagttcttcccatgattttgaaatcagctcttgaacttgatctcttagaaagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11639 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgtcatgcaactagcaagtgcttcagttcttcccatgattttgaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11640 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgtcatgcaactagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtaatcaacaagatggaaaagttcagagactttatggtttggctactgttgcta

SEQ ID NO: 11641 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgtcatgcaactagcaagggcttcagttcttcccatgattttgaaatcagctcttgaacttgatctcttataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11642 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgctatgcaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11643 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgctatgcaattagcaagtgcttcagttcttcccatgattttaaaatcagctcttgaacttgatctcttagaaatcataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 11644 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgctatgcaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11645 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgctatgcaactagcaagtgcttcagttcttcccatgattttgaaatcagctcttgaacttgatctcttagaaatcacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11646 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgctatgcaactagcaagtgcttcagttcttcccatgattttgaaatcagctcttgaacttgatctcttagaaatataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11647 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgctatgcaactagcaagtgcttcagttcttcccatgattttgaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11648 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgctatgcaactagcaagtgcttcagttcttcccatgattttgaaatcagctcttgaacttgataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 11649 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgctatgcaactagcaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11650 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgcgatgcaactagcaagtgcttcagttcttcccatgattttgaaatcagctcttgaacttgatctcttagaaatcagacctggtgctcaaatttcacctattgaaattgcttctcagataccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11651 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccttgcaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11652 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccttgcaattagcaagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11653 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccttgcaattagcaagtgcttcagttcttcccatgattttaaaatcagctcttgaacttgataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11654 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccttgcaactagcaagtgcttcagttcttcccatgattttgaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11655 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccttgcaactagcaagtgcttcagttcttcccatgattttgaaatcagctcttgaacttgatctcttagaataaagctggacctggtgctcaaatttcacctaatgaaattgcttctcagctcccaactactaaccctgatgcaccagttatgttggaccgaatgttgcgtctcttggcttgttacaatatcctcccttgttcagttcgtactcaacaagatggaaagattcagagactttatggtttggctactgttgctaa

SEQ ID NO: 11656 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccttgcaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11657 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccttgcaactagcaagtgcttcagttcttcccatgattttgaaatcagctcttgaacttgatctcttagaaagctaaagctggacctggtgctcaaatttcacctattgaaattgcttctcagctaccaacatctaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11658 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccgtgcaattagcaagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11659 - DNA, 367 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccgtgcaattagcaagtgcttcagttcttcccatgattttaaaatcagctcttgaacttgatctcttagaaatcatttgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11660 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccgtgcaattagcaagtgcttcagttcttcccatgattttaaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11661 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccgtgcaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11662 - DNA, 293 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccgtgcaactagcaagtgcttcagttcttcccatgattttgaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 11663 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccctgcaattagcaagtgcttcagttcttcccatgcttttaaaatcagctcttgaacttgatctcttagaaataaagctggaccttgtgctcaaatgtcacctattgaaattgcttctcagctcccaacaactaaccctgatgcaccagttatgttggaccgaatgttgcgtctctttgcttgttacaatatcctcacttgttcagttcgtactaaacaagatggaaagattcagagaatttattgtttggatactgttgctaa

SEQ ID NO: 11664 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccctgcaattagcaagtgcttcagttcttcccatgattttaaaatcagctcttgaacttgatctcttagaaatcttgctaaagctggaccgggtgctcaaatttcacctattgaaattgcttctcagctaccaacaactaaccctgatgcaccagttatgttggaccgaatgttgcgtctcttggcttgttacaatatcctcgcttgttcagttcgtactcaacaagatggaaagattcagagcctgtatggtttggctactgttgctaa

SEQ ID NO: 11665 - DNA, 312 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccctgcaattagcaagtgcttcagttcttcccatgattttaaaatcagctcttgaacttgatctcttagaaatcattccaacaactaaccctgatgcaccagttatgttggaccgaatgttgcgtctcttggcttgttacaatatcctcacttgttcagttcgtactcaacaagatggaaaggttcagagacgttatggtttggctactgttgctaa

SEQ ID NO: 11666 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccattcaattagcaagtgcttcagttcttcccatgattttgaaatcagctcttgaacttgatctcttagaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11667 - DNA, 478 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccattcaattagcaagtgcttcagttcttcccatgattttaaaatcagctcttgaacttgatctcttagaaatgggcctggcacagcaccggcaacagccgctggaccgtctccagcgcctgcttgccaccgccattgctggcgatggccaccacctgctggggggtcaagccgtgggcctggcacagcattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11668 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccattcaattagcaagtgcttcagttcttcccatgattttaaaatcagctcttgaacttgatctcttagaaatcactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgtggctaa

SEQ ID NO: 11669 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccattcaactatcaattgcttcagttcttcccatgattttgaaatcagctcttgaacttgatctcttagaaactaaagctggacctggtgctcaactttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11670 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgtaattagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11671 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgtaattagcaagtgcttcagttcttcccatgattttaaaatcagctcttgaacttgatttcttaaagctggacctggtgctcaaatttcacctattgaaattgcttctcagctaccaacaactaaccctgatgcaccagttatgttggaccgaatgttgcgtctcttggcttgttacaatatcctctcttgttcagttcgtactcaacaagatggaaagattcagggactttatggtttggctactgttgctaa

SEQ ID NO: 11672 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgtaattagcaagtgcttcagttcttcccatgattttaaaatcagctcttgaacttgattaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 11673 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgtaattagcaagtgcttcagttcttcccatgattttaaaatcagctcttgaacttgatctcttaggctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11674 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgtaattagcaagtgcttcagttcttcccatgattttaaaatcagctcttgaacttgatctcttagattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11675 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgtaattagcaagtgcttcagttcttcccatgattttaaaatcagctcttgaacttgatctcttagaataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagcctttatggtttggctactgttgctaa

SEQ ID NO: 11676 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgtaattagcaagtgcttcagttcttcccatgattttaaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttacggtttggctactgttgctaa

SEQ ID NO: 11677 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgtaattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11678 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgtaattagcaagtgcttcagttcttcccatgattttaaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcgcttgttcagttcgtactcaacaagatggaaaggttcagagactttatggtttggctactgttgctaa

SEQ ID NO: 11679 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgtaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11680 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgtaattagcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11681 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgtaattagcaagtgcttcagttcttcccatgattttaaaatcagctcttgaacttgatctcttagaaatcctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11682 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgtaattagcaagtgcttcagttcttcccatgattttaaaatcagctcttgaacttgatctcttagaaatcatgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11683 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgtaattagcaagtgcttcagttcttcccatgattttaaaatcagctcttgaacttgatctcttagaaatcactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11684 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgtaattagcaagtgcttcagttcttcccatgattttaaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11685 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgtaattagcaagtgcttcagttcttcccatgattttaaaatcagctcttgaacttgatctcttagaaatcaagctggacctggtgctcaaatttcacctattgaaattgcttctcagctaccaacaactaaccctgatgcaccagttatgttggaccgagtgttgcgtctcttgggttggtacaatatcctcacttgttcagttcgtactcaacaagatggaaaggttcagagactttatggtttggctactgttgctaa

SEQ ID NO: 11686 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgtaattagcaagtgcttcagttcttcccatgattttaaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11687 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgtaactagcaagtgcttcagttcttcccatgattttgaaatcagctcttgaacttgattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11688 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgtaactagcaagtgcttcagttcttcccatgattttgaaatcagctcttgaacttgatctcttagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11689 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgtaactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11690 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgtaactagcaagtgcttcagttcttcccatgattttgaaatcagctcttgaacttgatctcttagaaatcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11691 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgtaactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11692 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgtaactagcaagtgcttcagttcttcccatgattttgaaatcagctcttgaacttgatctcttagaaatcgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11693 - DNA, 424 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgtaactagcaagtgcttcagttcttcccatgattttgaaatcagctcttgaacttgatctcttagaaatcatgggtggcgggcaggacgcccgccataaactgccaggcatcaaactaagcagaaggccatccgaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11694 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgtaactagcaagtgcttcagttcttcccatgattttgaaatcagctcttgaacttgatctcttagaaatcatggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 11695 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgtaactagcaagtgcttcagttcttcccatgattttgaaatcagctcttgaacttgatctcttagaaagctggacctggtgatcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 11696 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgtaactagcaagtgcttcagttcttcccatgattttgaaatcagctcttgaacttgatctcttagaaactaaagctggacctggtgctcaaatttcacctattgaaattgctactcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 11697 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgtaactagcaagtgcttcagttcttcccatgattttgaaatcagctcttgaacttgatctcttacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11698 - DNA, 419 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgtaactagcaagtgcttcagttcttcccatgattttgaaatcagctcttgaacttgatctcggcttgaccccggagcaggtggtggccatcgccagcaatattggtggcaagcaggcgctggagacggtgcagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11699 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgtaactagcaagtgcttcagttcttcccatgattatgaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11700 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatggaattagcaagtgcttcagttcttcccatgattttgaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11701 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatggaattagcaagtgcttcagttcttcccatgattttaaaatcagctcttgaacttgatctcttagaaatcataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 11702 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatggaattagcaagtgcttcagttcttcccatgattttaaaatcagctcttgaacttgatctcttagaaatcaagctggacctggggctcaaatttcacctattgaaattgcttctcagctcccgacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11703 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatggaattagcaagtgcttcagttcttcccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11704 - DNA, 462 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatggaactagcaagtgcttcagttcttcccatgattttgaaatcagctcttgaacttgatctcttagaaatcactccgggccgttgcttcacaacgttcaaatccgctcccggcggatttgtcctactcaggagagcgttcaccgacaaacaacagacaaaacgaaaggcccagtcagatggacctggttctcaaatttcacctattgaaattgcttctcagctaccaacaactaaccctgatgcaccagttatgttggaccgaatgttgcgtctcttggcttgttacaatatcctcccttgttcagttcgtactcaacaagatggaaaggttcagagactttatggtttggctactgttgctaa

SEQ ID NO: 11705 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatggaactagcaagtgcttcagttcttcccatgattttgaaatcagctcttgaacttgatctcttagaaaaagctggacctagtgctcaaatttcacctattgaaattgcttctcagctacacacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11706 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatggaactagcaagtgcttcagttcttcccatgattttaaaatcagctcttgaacttgatctcttagaaattacagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11707 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgctactagcaagtgcttcagttcttcccatgattttgaaatcagctcttgaacttgatctcttagtgatcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11708 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgctactagcaagtgcttcagttcttcccatgattttgaaatcagctcttgaacttgatctcttagaaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11709 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcgattagcaagtgcttcagttcttcccatgattttgaaatcagctcttgaacttgatctcctagaaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11710 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcgattagcaagtgcttcagttcttcccatgattttaaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11711 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcgattagcaagtgcttcagttcttcccatgattttaaaatcagctcttgaacttgatctcttagaaatttaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 11712 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcgattagcaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11713 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcgattagcaagtgcttcagttcttcccatgattttaaaatcagctcttgaacttgatctcttagaaatcattgtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11714 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcgattagcaagtgcttcagttcttcccatgattttaaaatcagctcttgaacttgatatcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11715 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcgactagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11716 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcgactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11717 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcgactagcaagtgcttcagttcttcccatgattttgaaatcagctcttgaacttgatctcttaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11718 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgccattagcaagtgctccagttcttcccatgattttaaaatcagctcttgaacttgatctcttagattaaagctggacctggtgctcaaatttcacctattgaaattgcttctcagctcccaacaactaaccctgatgcaccagttatgttggaccgaatgttgcgtctcttggctggttacaatatcctcacttgttcagttcgtactcaacaagatggaaaggttcagagactttatggtttggctactgtagataa

SEQ ID NO: 11719 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgccactagcaagtgcttcagttcttcccatgattttgaaatcagctcttgaacttgatctcttagacattaaagctggacctggtgctcaaatttcacctattgaaattgcttctcagctaccaacaacgaaccctgatgcaccagttatgttggaccgaatgttgcgtctcttggctggttacaatatcctcacttgttctgttcgtactcaacaagatggaaagattcagagactttatggtttggctactgttgctaa

SEQ ID NO: 11720 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcatttagcaagtgcttcagttcttcccatgattttaaaatcagctcttgaacttgatctcttagaaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 11721 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcagttagcaagtgcttcagttcttcccatgattttaaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11722 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcagctagcaagtgcttcagttcttcccatgattttgaaatcagctcttgaacttgatctcttagaaataaaactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggcactgttgctaa

SEQ ID NO: 11723 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcagctagcaagtgcttcagttcttcccatgattttgaaatcagctcttgaacttgatctcttaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11724 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcactagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11725 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcactagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11726 - DNA, 394 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcactagcaagtgcttcagttcttcccatgattttgaaatcagctcttgaacttgaactcttagaaatcatatctgctgcttgcaaacaaaaaaaccaccgctaccagctagacctggcgcacaagtgtcacctattgaaattgcttctcagctaccaacatctaacccagaggtaccaaatatgttggaccggatggtgcatctcatgactagatacaatatcctcacttgtacagtgcgtactcaacaagatggaaagattcagagactgtatggtttggctaccggtgctaa

SEQ ID NO: 11727 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaatttgcaagtgcttcagttcttcccatgattttaaaatcagctcttgaacttgatctcttagactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11728 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattggcaagtgcttcagttcttcccatgattttgaaatcagctcttgaacttgatctcttagaaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11729 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattcgcaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11730 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattcgcaagtgcttcagttcttcccatgattttaaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11731 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattatcaagtgcttcagttcttcccatgattttgaaatcagctcttgaacttgatctcttagaaattaaagctggacctggtgctcaaatttcacctattgaaattgcttctcagctaccaacaactatccctgatgcaccagttatgttggaccgaatgttgcgtctattggcttgttgcaatatcctcacttgttcagttcgttgtcaacaagatggaaagattcagagactgtagggtttggctactgttgctaa

SEQ ID NO: 11732 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattatcaagtgcttcagttcttcccatgattttaaaatcagctcttgaacttgatctcttagataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactggtgctaa

SEQ ID NO: 11733 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagtaagtgcttcagttcttcccatgattttaaaatcagctcttgaacttgatctcttctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11734 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagtaagtgcttcagttcttcccatgattttaaaatcagctcttgaacttgatctcttagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11735 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagtaagtgcttcagttcttcccatgattttaaaatcagctcttgaacttgatctcttagataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11736 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagtaagtgcttcagttcttcccatgattttaaaatcagctcttgaacttgatctcttagaactggacctggtgctcaaatttcacctattgaaattgcttctcagctaccaacaactaaccctgatgcaccagttatgttggaccgaatgtttcgtctcctggcttgttacaatatcctcacttgttcagttcgtactcaacaagatggaaaggttcagagactttatggtttggctactgttgctaa

SEQ ID NO: 11737 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagtaagtgcttcagttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11738 - DNA, 391 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagtaagtgcttcagttcttcccatgattttaaaatcagctcttgaacttgatctcttagaaatcaagcgccggcctgccgccgccattgctggctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11739 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagtaagtgcttcagttcttcccatgattttaaaatcagctcttgaacttgatctcttagaaaattaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 11740 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagtaagtgcttcagttcttcccatgattttaaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11741 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagtaagtgcttcagttcttcccatgattttaaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11742 - DNA, 342 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagtaagtgcttcagttcttcccatgattttaaaatcagctcttgaacttgatctacctgttgctcaaatttcacctattgaaattgcttctcagctcccaacaactaaccctgatgcaccagttatgttggaccgaatgttgcgtctcttggcttgttacaatttcctcacttgttcagttcgtactcaacaagatggaaaggttcagagactttatggtttggctactgttgctaa

SEQ ID NO: 11743 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattaggaagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11744 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagctagtgcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11745 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagctagtgcttcagttcttcccatgattttaaaatcagctcttgaacttgatctcttagaaatctaaagctggacctggtgctcaaatttcacctattgaaattgcttctcagctaccaacaactaaccctgatgcaccagttatgttggaccgaatgttgcgcctcttggcttgttacaatatcctcacttgttcagttcgtactcaacaagatggaaaggttcagagactttatggtttggctactgttgctaa

SEQ ID NO: 11746 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagctagtgcttcagttcttcccatgattttaaaatcagctcttgaacttgatctcttagaaatcatggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 11747 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagctagtgcttcagttcttcccatgattttaaaatcagctcttgaacttgatctcttagaaataaagctggacctggtgctcaaatttcacctattgaaattgcttctcagctcccaacaacgaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11748 - DNA, 340 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagctagtgcttcagttcttcccatgattttaaaatcagctcttgaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11749 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcgagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11750 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcgagtgcttcagttcttcccatgattttaaaatcagctcttgaacttgatctcttagaataaagctggacctggtgctcaaatttcacctattgaaattgcttctcggctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11751 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcgagtgcttcagttcttcccatgattttaaaatcagctcttgaacttgatctcttagaaatcctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11752 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcgagtgcttcagttcttcccatgattttaaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11753 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcgagtgcttcagttcttcccatgattttaaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11754 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagccagtgcttcagttcttcccatgattttaaaatcagctcttgaacttgatctctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactgtatggtttggctactgttgcgaa

SEQ ID NO: 11755 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcatgtgcttcagttcttcccatgattttaaaatcagctcttgaacttgatctcttagaaattaaagctggacctggtgctcaaatttcacctatcgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11756 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcatgtgcttcagttcttcccatgattttaaaatcagctcttgaacttgatctcttagaaatcactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11757 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaggtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11758 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaggtgcttcagttcttcccatgattttaaaatcagctcttgaacttgatctcttagaaattaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11759 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaggtgcttcagttcttcccatgattttaaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11760 - DNA, 287 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaggtgcttcagttcttcccatgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11761 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcacgtgcttcagttcttcccatgattttaaaatcagctcttgaacttgatctcttagaaatcaaaagctggagctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11762 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcacgtgcttcagttcttcccatgattttaaaatcagctcttgaacattgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgtggctaa

SEQ ID NO: 11763 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaattgcttcagttcttcccatgattttaaaatcagctcttgaacttgatctcttagaaatcatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11764 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaattgcttcagttcttccaatgattttaaaatcagctcttgaacttgatctcttagaaataaagctggacctgttgctcaaatttcacctattgaaattgcttctcagctcccaacaactaaccctgatgcaccagttatgttggaacgaatgttgcgtctcttggcttattacaatatcctcacttgttcagttcgtactcaacaagatggaaaggttcagagcctttatggtttggctactattgctaa

SEQ ID NO: 11765 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagttcttcagttcttcccatgattttaaaatcagctcttgaacttgatctcttagaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11766 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagttcttcagttcttcccatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11767 - DNA, 455 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagttcttcagttcttcccatgattttaaaatcagctcttgaacttgatctcttagaaatcattgaccatgattacgaattcccgatctagtaggcctccagagcgcgtgcgccggaccactgtttgccgacgccaacgatcgcttcgtgtgtgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11768 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagttcttcagttcttcccatgattttaaaatcagctcttgaacttgatctcttagaaatcattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagcctttatggtttggctactgttgctaa

SEQ ID NO: 11769 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagttcttcagttcttcccatgattttaaaatcagctcttgaacttgatctcttagaaataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagacttcatggtttggctactgttgctaa

SEQ ID NO: 11770 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgctttagttcttcccatgattttgaaatcagctcttgaacttgttctcttagaaatcattaaagctgtacctggtgctcaaatttcacctattgaaattgcttctcagctaccaacaactaaccctgatgcaccagttatgttggaccgaatgttgcgtctcttggcttgttacaatatcctcccttgttcagttcgtactcaacaagatggaaaagttcagagactttatggtttggctactgttgctaa

SEQ ID NO: 11771 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgctttagttcttcccatgattttaaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11772 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttgagttcttcccatgattttgaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11773 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcggttcttcccatgattttgaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11774 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcggttcttcccatgattttgaaatcagctcttgaacttgatctcttaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11775 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcggttcttcccatgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11776 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcggttcttcccatgattttaaaatcagctcttgaacttgatctcttagaaatcataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11777 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcggttcttcccatgattttaaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11778 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcggttcttcccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11779 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttccgttcttcccatgattttaaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11780 - DNA, 317 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11781 - DNA, 317 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttttaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 11782 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttctttccatgattttaaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11783 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttctttccatgattttaaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11784 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttctcatgattttgaaatcagctcttgaacttgatctcttagaaatcattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11785 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttctcatgattttaaaatcagctcttgaacttgatctcttagaaataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 11786 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttctcatgattttaaaatcagctcttgaacttgatctcttagaaataaagctggacctggtgctcaaatttcacctgttcaaattgcttctcagcttccaacaactaaccctgatgcaccagtcatgttggaccgaatgttgcgtctcttggcttgtcacaatatcctcacttgttctgttcgtactcaacaagatggaaaggttcagagactttatggtttggccactgttgctaa

SEQ ID NO: 11787 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttctcatgattttaaaatcagctcttgaacttgatctctaaagctggacctggtgctcaaatttcacctattgaaattgtttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11788 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttctcatgattttaaaatcagctcttgaacttagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 11789 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcctatgattttgaaatcagctcttgaacttgatctcttagaaattggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11790 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcctatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11791 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcctatgattttgaaatcagctcttgaacttgatctcttagaaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 11792 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcctatgattttaaaatcagctcttgaacttgatctcttggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11793 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcctatgattttaaaatcagctcttgaacttgatctcttagaatcatgctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 11794 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcctatgattttaaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11795 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccttgattttaaaatcagctcttgaacttgatctcttagaaatataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11796 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccgtgattttaaaatcagctcttgaacttgatctcttaggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11797 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccgtgattttaaaatcagctcttgaacttgatctcttagaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11798 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccgtgattttaaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11799 - DNA, 342 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccattattttgaaatcagctcttgaacttgatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctcctgttgctaa

SEQ ID NO: 11800 - DNA, 364 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgtttttaaaatcagctcttgaacttgatctcttagaaatcagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11801 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatggttttgaaatcagctcttgaacttgatctcttagaaatcactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11802 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatggttttgaaatcagctcttgaacttgatctcttactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11803 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgatttttaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11804 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgatttttaaatcagctcttgaacttgatctcttagaaaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 11805 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgatttttaaatcagctcttgaacttgatctcactaaagctggacctggtactcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11806 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgatatcagctcttgaacttgatctcttagaaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11807 - DNA, 293 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11808 - DNA, 293 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaattgcttctcagctcccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 11809 - DNA, 293 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11810 - DNA, 293 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11811 - DNA, 293 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11812 - DNA, 293 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaattgcttctcagctaccaacaactaaccctgatccaccagttatgttggaccgaatgttgcgtctcttggcttgttacaatatcctcacttgttcagttcgtactcaacaagatggaaaagttcagagactttatggtttggctactgttgctaa

SEQ ID NO: 11813 - DNA, 333 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11814 - DNA, 333 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatctaaagctggacctggtgctcaaatttcacctattgaaagtgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11815 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgagcttgatctcttagaaatcaaaagctggacctggtgctcaaatttcacctattgaaattgcttctaagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11816 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11817 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11818 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11819 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgagctaaagctggacccggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11820 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11821 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11822 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11823 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaatgttcagagactttatggtttggctactgttgctaa

SEQ ID NO: 11824 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaactttatctcttagaaataagctggacctggtgctcaaatttcacctattgaaattgcttctcagctaccaacaactaaccctgatgcaccagttatgttggaccgaatgttgcgtctcttggcttgttacaatatcctctcttgttcagttcgtactcaacaagatggaaagattcagagactttatggtttggctactgttgctaa

SEQ ID NO: 11825 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11826 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttggtctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11827 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatttcttagaaattaaagctggacctggtgctcaaatttcacctattgaaattgcttctcagctaccaacaactaaccctgatgcaccagttatgttggaccgaaagttgcgtcgcttggcttgttacaatatcctcacttgttcagttcgtactcaacaagatggaaaggttcagagactttatggtttggctactgttgctaa

SEQ ID NO: 11828 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatttcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11829 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11830 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11831 - DNA, 342 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11832 - DNA, 342 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11833 - DNA, 342 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11834 - DNA, 342 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 11835 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11836 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatcttgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11837 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatcttgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11838 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatcttctggacctggtgctcaaatttcacctattgaaattgcttctcagctcccaacaactaaccctgatgcaccagttatgttggaccgaatgttgcgtctcttggcttgttacaatatcctcacttgttcagttcgcactcaacaagatggaaagattcagagactttatggtttggctactgttgctaa

SEQ ID NO: 11839 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatcttctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11840 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatcttctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11841 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11842 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11843 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11844 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttgtggtttggctactgttgctaa

SEQ ID NO: 11845 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11846 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctctttaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 11847 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctctttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11848 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctctttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11849 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttggacctggtgctcaaatttcacctattgaaattgcttctcagctcccaacaactaaccctgatgcaccagttatgttggaccgaatgttgcatctcttggattgtaacaatatcctcacttgttgagttcgtactcaacaagatggaaagattcagagactttatgagttggctactgttgctaa

SEQ ID NO: 11850 - DNA, 426 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttgctggggggtcaagccgtgggcctggcacagcaccggcaacagccgctggaccgtctccagcgcctgcttgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11851 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11852 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttctaaagctggacctggtgctcaaatttcacctattgaaattgcttctcagctaccaacaactaaccctgatgcaccagttatgttggaccgaatgttacgtctcttggcttgttacaatatcctcacttgttcagttcgtactcaacaagatggaaagattcagagactttatggtttggctactgttgctaa

SEQ ID NO: 11853 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11854 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11855 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttctaaagctggacctggtgctcaaatttcacctattgaaattgcttctcagctaccaacaactaaccctgatgcaccagttatgttggaccgaatgttgtgtctcttggcttgttacaatatcctcacttgttcagttcgtactcaacaagatggaaaggttcagagactttatggtttggctactgttgctaa

SEQ ID NO: 11856 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 11857 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 11858 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11859 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11860 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagttggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11861 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11862 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11863 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagtgatcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11864 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagtaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 11865 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagtaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 11866 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagtaaagctggacctggtgctcaaatttcacctattgaaattgcttctcagctcccaacaactaaccctgatgcaccagttatgttggacctaatgttgcgtctcttggcttgttacaatatcctcacttgttcagttcgtactcaacaagatggaaagattcagagactttatggtttggctactgttgctaa

SEQ ID NO: 11867 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11868 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11869 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatagaaagattcagagactttatggtttggctactgttgctaa

SEQ ID NO: 11870 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11871 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11872 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11873 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagtaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 11874 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttaggctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11875 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttaggacctggtgctcaaatttcacctattgaaattgcttctcagctaccaacaactacccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11876 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttaggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11877 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttaggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11878 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11879 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11880 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagctggacctggtgctcaaatttcacctattgaaattgcttctcagctcccaacaactaaccctgatgcaccagttatgttggaccgaatgttgcgtctcttggctagttacaatatcctcacttgttcagttcgtactcaacaagatggaaaggttcagagactttatggtttggctactgttgctaa

SEQ ID NO: 11881 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagctggacctggtgctcaaatttcacctattgaaattgcttctcagctcccaacaactaaccctgatgcaccagttatgttgaaccgaatgttgcgtcacttggcttgttacaatatcctcacttgttcagttcgtactcaacaagatggaaaggttcagagactttatggtttggctactgttgctaa

SEQ ID NO: 11882 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11883 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11884 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagctggacctggtgctcaaatttcacctattgaaattgcttctcagctaccaacaactaaccctgatgcaccagttatgttggaccgaatgttgcgtctcttggcttgttacgatatcctcacttgttcagttcgtactcaacaagatggaaaggttcagagactttatggtttggctactgttgctaa

SEQ ID NO: 11885 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11886 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagctggacctggtgctcaaatttcacctattgaaattgcttctcagctaccaacaactaaccctgatgcaccagttatgttggaccgaatgctgcgtctcttggcttgttacaatatcctcacttgttcagttcgtactcaacaagatggaaaggttcagagactttatggtttggctactgttgctaa

SEQ ID NO: 11887 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagctaaagctggacctggtgctcaaatttcgcctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 11888 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11889 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11890 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11891 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11892 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagctaaagctggacctggtgctcaaatttcacctattgaaattgcttctcagctcccaacaactaaccctgatgcaccagttatgttggacagaatgttgcgtctcttggcttgttacaatatcctcacttgttcagttcgtactcaacaagatggaaagattcagagactttatggtttggctactgttgctaa

SEQ ID NO: 11893 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 11894 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11895 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11896 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 11897 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagctaaagctggacctggtactctaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11898 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11899 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11900 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagatcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11901 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagataaagctggacctggtgctcaaatttcacctattgaaattgcttctcatctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11902 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagataaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 11903 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11904 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11905 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagattgaaaggttcagagactttatggtttggctactgttgctaa

SEQ ID NO: 11906 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagataaagctggacctggtgctcaaatttcacctattgaaattgcttctcagctcccaacaactaaccctgatgcaccagttatgttggaccgaatgttgcgtcacttggcttgttacaatatcctcacttgttcagttcgtactcaacaagacggaaaggttcagagactttatggtttggctactgttgctaa

SEQ ID NO: 11907 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactatatggtttggctactgttgctaa

SEQ ID NO: 11908 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11909 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11910 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactggtgctaa

SEQ ID NO: 11911 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagataaagctggacctggtgctcaaatttcacctattgaaattgcttctcagctaccaacaactaaccctgatgcaccagttatgttggaccggatgttgcgtctcttggcttgttacaatatcctcacttgttcagttcgtactcaacaagatggaaaagttcagagactttatggtttggctactgttgctaa

SEQ ID NO: 11912 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagagtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11913 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11914 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11915 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11916 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11917 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctatgttgctaa

SEQ ID NO: 11918 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11919 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgtcgctaa

SEQ ID NO: 11920 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagagctggacctggtgctcaaacttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11921 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagagatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11922 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagagataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11923 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11924 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11925 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11926 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagactggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 11927 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagactacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11928 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagactaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 11929 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagactaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11930 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11931 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11932 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagactaaagctggacctggtgctcaaatttcacctattgaaattgcttctcagctaccaacaactaaccctgatgcaccagttatgttggaccgaatgttgcgtctcttggcttgttacaatatcctcacttgttcagctcgtactcaacaagatggaaaagttcagagactttatggtttggctactgttgctaa

SEQ ID NO: 11933 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11934 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11935 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagacataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11936 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagacataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11937 - DNA, 419 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaatttcccgactggaaagcgggcagtgagcgcaacgcaattaatacgcgtaccgctagccagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11938 - DNA, 419 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaatttcccgactggaaagcgggcagtgagcgcaacgcaattaatacgcgtaccgctagccagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11939 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaattaaagctggacctggtgctcaaatttcacctgttcaaattgcttctcagcttccaacaactaaccctgatgcaccagtcatgttggacccaatgttgcgtctcttggcttgttacaatatcctcacttgttctgttcgtactcaacaagatggaaaggttcagagactttatggtttggctcctgttgctaa

SEQ ID NO: 11940 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11941 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11942 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11943 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 11944 - DNA, 398 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaatgtccagcggctgttgccggtgctgtgccaggcccacggctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11945 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaatggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11946 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaatggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11947 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11948 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11949 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttacggtttggctactgttgctaa

SEQ ID NO: 11950 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaatgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11951 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaatgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11952 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaatgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11953 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaatgagctcaaatttcacgtattgaaatttcttctcagctaccaacaactaaccctgatgcaccagttatgttggaccgaatgttgcgtctcttggcttgttacaattgcctctcttgttcagttcgtactcaacaagatggaaaggttcagagactttatggtttggcgacaggtgctaa

SEQ ID NO: 11954 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaatctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 11955 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaatcctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11956 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaatcatgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11957 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaatcataaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11958 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaatcataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttgctactgttgctaa

SEQ ID NO: 11959 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaatcactaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11960 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11961 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11962 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaataaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11963 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 11964 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 11965 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 11966 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 11967 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaataaagctggacctggtgctcaaatttcacctattgtaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11968 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11969 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11970 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaataaagctggacctggtgctcaaatttcacctattgaaattgcttctcagctcccaacaactaaccctgatgcaccagctatgttggaccgaatgttgcgtctcttggcttgttacaatatcctcacttgttcagttcgtactcaacaagatggaaaggttcagagactttatggtttggctactgttgctaa

SEQ ID NO: 11971 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11972 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 11973 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11974 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11975 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcttcacttgttcagttcgtactcaacaagatggaaaggttcagagactttatggtttggctactgttgctaa

SEQ ID NO: 11976 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcagcaagatggaaaggttcagagactttatggtttggctactgttgctaa

SEQ ID NO: 11977 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaataaagctggacctggtgctcaaatttcacctattgaaattgcttctcagctaccaacaactaaccctgatgcaccagttatgttggaccgaatgttgcttctcttggcttgttacaatatcctcacttgttcagttcgtactcaacaagatggaaaggttcagagactttatggtttggctactgttgctaa

SEQ ID NO: 11978 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11979 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11980 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaagctgtacctggtgctcaaatttcacctattgaaactgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11981 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11982 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11983 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11984 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 11985 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11986 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11987 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11988 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgtggctaa

SEQ ID NO: 11989 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcggagactttatggtttggctactgttgctaa

SEQ ID NO: 11990 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11991 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11992 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 11993 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcggttcgtactcaacaagatggaaaggttcagagactttatggtttggctactgttgctaa

SEQ ID NO: 11994 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 11995 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaagctggacctggtgctcaaatttcacctattgaaattgcttctcagctaccaacaactaaccctgatgcaccagttatgttggaccgaatgttgcgtctcttggcttgttacaatatcctcacttgttcagttcgtcctcaacaagacggaaaggttcagagactttatggtttggctactgttgctaa

SEQ ID NO: 11996 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaagctggacctggtgctcaaatttcacctattgaaattgcttctcagctaccaacaactaaccctgatgcaccagttatgttggaccaaatgttgcgtctcttggcttgttacaatatcctcacttgttcagttcgtactcaacaagatggaaaggttcagagactttatggtttggctactgttgctaa

SEQ ID NO: 11997 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaagctggacctggtgatcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 11998 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaagctaaagctggacctggtgctcaaatttcacctattgaaattgtttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 11999 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12000 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12001 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12002 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgcta

SEQ ID NO: 12003 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaactggtgctcaaatttcacctattgaaattgcttctcagctctcaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12004 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaactggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12005 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaactggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12006 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaactggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12007 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaactggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 12008 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12009 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12010 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12011 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12012 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12013 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaactaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 12014 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaactaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 12015 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12016 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12017 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaactaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 12018 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12019 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12020 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12021 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12022 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaactaaagctggacctggtgctcaaatttcacctatcgaaattgcttctcagctaccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 12023 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaactaaagctggacctggtgctcaaaattcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12024 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12025 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12026 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaacattaaagctggacctggtgctcaaatttcacctattgaaattgtttctcagctaccaacaactaaccctgatgcaccagttatgttggaccgaatgttgcgtctcttggcttgttacaatatcctcacttgttcagttcgtactcaacaagatggaaaggttcagagactttatggtttgcctactgttgctaa

SEQ ID NO: 12027 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaacattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12028 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaacattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12029 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaacattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12030 - DNA, 364 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatttgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12031 - DNA, 364 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatttgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12032 - DNA, 364 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatttgctaaagctggacctggtgctcaaatttcacctattgaaattgcttctcagctaccaacaactaaccctgatgcaccagttatgttggaccgaatgttgcgtctcttggcttgttacaatatcctcacgtgttcagttcgtactcaacaagatggaaagattcagagactttatggtttggctactgttgctaa

SEQ ID NO: 12033 - DNA, 389 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatttgcacaagataaaaatatatcatcatgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12034 - DNA, 414 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatttgacggatggccttctgcttagtttgatgcctggcagtttatggcgggcgtcctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12035 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatttaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12036 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatttaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 12037 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12038 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12039 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12040 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactggtgctaa

SEQ ID NO: 12041 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 12042 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacgagatggaaaggttcagagactttatggtttggctactgttgctaa

SEQ ID NO: 12043 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12044 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatttaaacctggacctggtgcccaaatttcacctattgaaattgcttctcagctaccaacaactaaccctgatgcaccagttatgttagaccgaatgttgcgtctcttggcttgttacaatatcctcacttgttcagttcgtactcaacaagatggaaaggttcagagactttatggtttggctactgttgctaa

SEQ ID NO: 12045 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12046 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattggacctggtgctcaaatttcacctattgaaattgcttctcagctaccaacaactaaccctgatgcaccagttatgttggaccgtatgttgcgtctcttggcttgttacaatatcctcacttgttcagttcgtactcaacaagatggaaaggttcagagactttatggtttggctactgttgctaa

SEQ ID NO: 12047 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctacgttgctaa

SEQ ID NO: 12048 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12049 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12050 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12051 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattgctaaatggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12052 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattgctaaatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12053 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattgctaaatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12054 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12055 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12056 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 12057 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12058 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12059 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12060 - DNA, 475 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattatgtcgtttacctatccaacgaattgtcacatgctaagattcaatgcaaatcggccacattatggccttcctagtaaaaaagggtcgaaaacgagtaatgtcctaaattaacgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactaaacaagatggaaaggttcagagactttatggtttggctactgttgctaa

SEQ ID NO: 12061 - DNA, 310 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12062 - DNA, 310 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12063 - DNA, 310 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 12064 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12065 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattaaagctggtcctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12066 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattaaagctggacctggtgctcaaatttgacctattgaaattgcgtctcagctaccaacaactaaccctgatgcaccagttatgttggaccgaatgttgcgtctcttggcttgttacaatatcctcacttgttcatttcgtactcaacaagatggaaaagttcagagactttatcgtttggctactgttgctaa

SEQ ID NO: 12067 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 12068 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 12069 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattaaagctggacctggtgctcaaatttcacctgttcaaattgcttctcagcttccaacaactaaccctgatgcaccagtcatgttggaccgtatgttgcgtctcttggcttgttacaatatcctcacttgttctgttcggcatcaacaagatggaaagggtcagagcctttaacgtttggctactggtgctaa

SEQ ID NO: 12070 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12071 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12072 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12073 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12074 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12075 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12076 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 12077 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaacacggaaaggttcagagactttatggtttggctactgttgctaa

SEQ ID NO: 12078 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagtacgtactcaacaagatggaaagattcagagactttatggtttggctactgttgctaa

SEQ ID NO: 12079 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 12080 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattaaagctggacctggtgctcaaatttcacctattgaaattgcttctcagctaccaacaactaactctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12081 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgtttgaccgaatgttgcgtctcttggcttgttacaatatcctcacttgttcagttcgtactcaacaagatggaaaggttcagagactttatggtttggctactgttgctaa

SEQ ID NO: 12082 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12083 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12084 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12085 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtgctcaacaagatggaaaggttcagagactttatggtttggctactgttgctaa

SEQ ID NO: 12086 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 12087 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgtggctaa

SEQ ID NO: 12088 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctctttgcttgttacaatatcctcacttgttcagttcgtactcaacaagatggaaagattcagagactttatggtttggctactgttgctaa

SEQ ID NO: 12089 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgtgtctcttggcttgttacaatatcctcacttgttcagttcgtactcaacaagatggaaaggttcagagactttatggtttggctactgttgctaa

SEQ ID NO: 12090 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagatttagagactttatggtttggctactgttgctaa

SEQ ID NO: 12091 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcggttcgtactcaacaagatggaaaagttcagagactttatggtttggctactgttgctaa

SEQ ID NO: 12092 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacctgttcagttcgtactcaacaagatggaaagattcagagactttatggtttggctactgttgctaa

SEQ ID NO: 12093 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactgtatggtttggctactgttgctaa

SEQ ID NO: 12094 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 12095 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaagttcagagactttatcgtttggctactgttgctaa

SEQ ID NO: 12096 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattaaagctggacctggtactcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12097 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaattaaagctggacctagtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12098 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatgtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12099 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatgtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12100 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctacctgttgctaa

SEQ ID NO: 12101 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12102 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatggacctggtgctcaaatttcacctattgaaattgtttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12103 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12104 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12105 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 12106 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12107 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatgacctggtgctcaaatttctcctattgaaattgcttctcagctcccaacaactaaccctgatgcaccagttatgttggaccgaatgttgcgtctcttggcttgttacaatatcctcacttgttcagttcgtactcaacaagatagaaagattcagagactttatggtttggctactgttgctaa

SEQ ID NO: 12108 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatgacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12109 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatgacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12110 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcttgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12111 - DNA, 319 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12112 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcttaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12113 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12114 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12115 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12116 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcttaaagctggacctggtgctcaaatttcacctattgaaattgcttctcagctaccaacaactaaccctgatgcaccagttatgttggaccgaatgttgcgtctcttggcttgttaaaatatcctcacttgttcagttcgtactcaacaagatggaaagattcagagactttatggtttggctactgttgctaa

SEQ ID NO: 12117 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12118 - DNA, 397 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctggcggtggccaccacctgctggggggtcaagccgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12119 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12120 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 12121 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12122 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgtgctaa

SEQ ID NO: 12123 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12124 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 12125 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12126 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactggtgctaa

SEQ ID NO: 12127 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12128 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12129 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctggacctggtgctcaaatttcacctattgaaattgcttctcagctaccaacaactaaccctgatgcaccagttatgttggaccgaatgttgcgtctcttgacttgttacaatatcctcacttgttcagttcgtactcaacaagatggaaaggttcagagactttatggtttggctactgttgctaa

SEQ ID NO: 12130 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctggacctggtgcccaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12131 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctgctggacctggtgctcaaatttcacctattgaaattgcttctcagctcccaacaactaaccctgatgcaccagttatgttggaccgaatgttgcgtctcctggcttgttacaatatcctcacttgttcagttcgtactcaacaagatggaaaggttcagagactttatggtttggctactgttgctaa

SEQ ID NO: 12132 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12133 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12134 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12135 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12136 - DNA, 393 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctccagcgccggcctgccgccgccattgccatctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 12137 - DNA, 393 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctccagcgccggcctgccgccgccattgccatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12138 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctacagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 12139 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctacagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12140 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaagctggacctggtgctcaaatttcacctattgaaattgcttctcagctcccaacaactaaccctgatgcaccagttatgttggacctaatgttgcgtctcttggcttgttacaatatcctcacttgttcagttcgtactcaacaagattgaaaggttcagagactttatggtttggctactgttgctaa

SEQ ID NO: 12141 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12142 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12143 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaagctggacctggtgctcaaatttcacctattgaaattgcttctcagctaccaacaactaaccctgatgcaccagttatgttggaccgaatgttgcgtctcttggtttgttacaatatcctcacttgttcagttcgtactcaacaagatggaaaggttcagagactttatggtttggctactgttgctaa

SEQ ID NO: 12144 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12145 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaatctggacctggtgctcaaatttcacctattgaaattgcttctcagctaccaacaactaaccctgatgcaccagttatgttggaccgaatattgcgtctcttggcttgttacactatcctcacttgttcagttcgtactcaacaagatggaaaagttccgagactttatggtttggctactgttgctaa

SEQ ID NO: 12146 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagcttgacctggtgctcaaatttcacctattgaaattgcttctcagctaccaacaactaaccctgatgcaccagttatgttggaccgaatgttgcgtctcttggcttgttacaatatcctcacttgttcagtacgtactcaacaagatggaaaggttcagagactttatggtttggctactgttgctaa

SEQ ID NO: 12147 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacttggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12148 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggaccttgtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 12149 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaattttacctattgaaattgcttctcagctaccaacaactaaccctgatacaccagttatgttggaccgaatgttgcgtctcttggcttgttacaatatcctcacttgttcagttcgtactcaacaagatggaaaagttcagagactttatggtttggctactgttgctaa

SEQ ID NO: 12150 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 12151 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 12152 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 12153 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctgttcaaattgcttctcagcttccaacaactaaccctgatgcaccagtcatgttggacctaatgttgcgtctcttggcttgttacaatatcctcacttgttcagttcgtactcaacaagatggaaagattcagagactttatggtttggctactgttgctaa

SEQ ID NO: 12154 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12155 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12156 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12157 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctgttcaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 12158 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaacttgcttctcagctaccaacaactaaccctgatgcaccagttatgttggaccgtatgttgcgtctcttggcttgttacaatatcctcgcttgttcagttcgttctcaacaagatggaaaagttcagagtctttatggtttggctactgttgctaa

SEQ ID NO: 12159 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgtttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12160 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgtttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 12161 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 12162 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 12163 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaagttcagagactttatggtttggctactgttgctaa

SEQ ID NO: 12164 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 12165 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12166 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12167 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttttggtttggctactgttgctaa

SEQ ID NO: 12168 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacgagatggaaaggttcagagactttatggtttggctactgttgctaa

SEQ ID NO: 12169 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12170 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtcccttggcttgttacaatatcctcacttgttcagttcgtactcaacaagatggaaaggttcagagactttatggtttggctactgttgctaa

SEQ ID NO: 12171 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 12172 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatgatttggctactgttgctaa

SEQ ID NO: 12173 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgtgcgtctcttggcttgttacaatatcctcacttgttcagttcgtactcaacaagatggaaagattcagagactttatggtttgctactgttgctaa

SEQ ID NO: 12174 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatgtttggctactgttgctaa

SEQ ID NO: 12175 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccaaatgttgcgtctcttggcttgttacaatatcctcacttgttcagttcgtactcaacaagatggaaaggttcagagactttatggtttggctactgttgctaa

SEQ ID NO: 12176 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaacgttcagagactttatggtttggctactgttgctaa

SEQ ID NO: 12177 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagacgttatgggttggctactgttgctaa

SEQ ID NO: 12178 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 12179 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12180 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12181 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12182 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgtgctaa

SEQ ID NO: 12183 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtcgcttggcttgttacaatatcctcacttgttcagttcgtactcaacaagatggaaaggttcagagactttatggtttggctactgttgctaa

SEQ ID NO: 12184 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcactttttcagttcgtactcaacaagatggaaaggttcagagactttatggtttggctactgttgctaa

SEQ ID NO: 12185 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 12186 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 12187 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggttggctactgttgctaa

SEQ ID NO: 12188 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaacgttgcgtctcttggcttgttacaatatcctcacttgttcagttcgtactcaacaagatggaaaggttcagagactttatggtttggctactgttgctaa

SEQ ID NO: 12189 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacctgttctgttcgtactcaacaagatggaaaggttcagagactttatggtttggctactgttgctaa

SEQ ID NO: 12190 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctattggcttgttacaatatcctcacttgttcagttcgtactcaacaagatggaaagattcagagactttatggtttggcgactgttgctaa

SEQ ID NO: 12191 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggcttggctactgttgctaa

SEQ ID NO: 12192 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagaccttatggtttggctactgttgctaa

SEQ ID NO: 12193 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 12194 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagattttatggtttggctactgttgctaa

SEQ ID NO: 12195 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagttatgttggaccgaatgtggcgtctcttggcttgttacaatatcctcacttgttcagttcgtactcaacaagatggaaaggttcagagactttatggtttggctactgttgctaa

SEQ ID NO: 12196 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 12197 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 12198 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 12199 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgcttctcagctaccaacaactaaccccgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12200 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattgaaattgcttctcagctaccaacaacgaaccctgatgcaccagttatgttggaccgaatattgcgtctcttggcttgttacaatatcctcacttgttcagttcgtactaaacaagatggaaaggttcagagactttatggtttggctactgttgctaa

SEQ ID NO: 12201 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaatttcacctattcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12202 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctggacctggtgctcaaaattcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12203 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatctaaagctgaacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12204 - DNA, 421 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcgttggtagctcttgatccggcaaacaaaccaccgctggtagcggtggtttttttgtttgctaaagctggacctggtgctcaaatttcacctattgaaattgcttctcagctaccaacaactaaccctgatgcaccagttatgttggaccgaatgttgcgtctcttggcttgttgcaatatcctcacttgttctgttcgtactcaacaagatggaaagattcagagactttatggtttggctactgttgctaa

SEQ ID NO: 12205 - DNA, 413 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcgtggggcacgtacttcagcttgtgcctcaactcggatttcttctcctccagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12206 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcgtgctcaaatttcacttattgaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 12207 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcgtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12208 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcgtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12209 - DNA, 389 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcggcagcgttagggaccgtcgctgtcaagtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12210 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcgctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 12211 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12212 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12213 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12214 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12215 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgtgctaa

SEQ ID NO: 12216 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12217 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcgctaaagctggaccttgtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12218 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12219 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12220 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12221 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12222 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcgacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 12223 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12224 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 12225 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12226 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12227 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12228 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12229 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12230 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 12231 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcctaaagctggtcctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12232 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12233 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcctaaagctggacctggtgctcaaatttcacctattgaatttgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 12234 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12235 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12236 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12237 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12238 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12239 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctctgttgctaa

SEQ ID NO: 12240 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcctaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 12241 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcctaaagctggacctggtgcccaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctatgttgctaa

SEQ ID NO: 12242 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcctaaagctggacctggtgcacaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12243 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatccgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12244 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatccgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12245 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatccgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12246 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatccgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaatatggaaaggttcagagactttatggtttggctactgttgctaa

SEQ ID NO: 12247 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatccaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12248 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatccaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12249 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcatttcacctgttcaaattgcttctcagcttccaacaactaaccctgatgcaccagtcatgttggaccgaatgttgcgtctcttggcttgttacaatatcctcactttttcagttcgtactcaacaagatggaaaggttcagagactttatggtttggctactgttgctaa

SEQ ID NO: 12250 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 12251 - DNA, 432 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcatttacgccaacggttgaagtgccgatttgcggtcacgcgacagtagctgcgcactatgtacgtgcgaaggtgaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12252 - DNA, 383 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgtgacgctcaagtcagaggtaaagctggacctggtgctcaaatttcacctattgaaattgcttctcagctaccaacaactaacccttatgctccagttatcttggaccggatgttgcgtctcttggcttgttacaatatcctcacttgttcagttcgtactcaacaagatggaaaggttcagagactttatggtttggctactgttgctaa

SEQ ID NO: 12253 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12254 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12255 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12256 - DNA, 472 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattggtggccatcgccagcaatggcggtggcaagcaggcgctggagacggtccagcggctgttgccggtgctgtgccaggcccacggcttgaccccggagcaggtggtggctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12257 - DNA, 472 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattggtggccatcgccagcaatggcggtggcaagcaggcgctggagacggtccagcggctgttgccggtgctgtgccaggcccacggcttgaccccggagcaggtggtggctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12258 - DNA, 472 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattggtggccatcgccagcaatggcggtggcaagcaggcgctggagacggtccagcggctgttgccggtgctgtgccaggcccacggcttgaccccggagcaggtggtggctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12259 - DNA, 472 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattggtggccatcgccagcaatgccggtggcaagcaggcgctggagccggcccagcggctgttgccggtgctgtgccaggcccacggcttgaccccggagcaggtggtggctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12260 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12261 - DNA, 421 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgggcctggcacagcaccggcaacagccgctggaccgtctccagcggctgcttgccgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12262 - DNA, 420 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattggagacggtccagcggctgttgccggtgctgtgccaggcccacggcttgacccccctaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 12263 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12264 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 12265 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12266 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12267 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12268 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattggacctggtgctcaaatttcacctattgaaattgattctcagctcccaacaactaagcctgatacaccagttatgttggaccgaatgttgcgtctattggattgttacaatatcctcacttgttcagttcgtactcaacacgatggaaaagttcagagactttatggtttggctactgttgctaa

SEQ ID NO: 12269 - DNA, 390 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctggcgatggccaccacctgctccctaaagctggacctggtgctcaaatttcacctgttcaaattacttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 12270 - DNA, 390 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctggcgatggccaccacctgctccctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12271 - DNA, 396 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctggagacggtccagcggctgttgccggtgctaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12272 - DNA, 396 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctggagacggtccagcggctgttgccggtgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12273 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12274 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12275 - DNA, 364 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagcctttatggtttggctactgttgctaa

SEQ ID NO: 12276 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12277 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12278 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12279 - DNA, 419 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgccgtgggcctggcacagcaccggcaacagcgcctgcaccgtctccagcgcttgctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12280 - DNA, 434 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgccggtgctgtgccaggcccacggcttgaccccggagcaggtggtggccatcgccagcaatggcggtggctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12281 - DNA, 429 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgccgccatcgtggctggcgatggccaccacctgctccggggtcaagccgtgggcctggcacaggctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12282 - DNA, 429 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgccgccatcgtggctggcgatggccaccacctgctccggggtcaagccgtgggcctggcacaggctaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 12283 - DNA, 406 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgcccacggcttgaccccggagcaggtggtggccatcgccagctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 12284 - DNA, 429 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgcaacgcaattaatacgcgtaccgctagccaggaagagtttgtagaaacgcaaaaaggccatccgtaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12285 - DNA, 396 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgaccgagttcaagttcctgttcgtgtccggcctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12286 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12287 - DNA, 312 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 12288 - DNA, 312 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12289 - DNA, 338 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12290 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattaaagctggacctggtgctcaaatttcgcctattgaaattgcttctcagctcccaacaactaaccccgatgcaccagttatgttggaccgaatgttgcgtctctgggcttgttacaatatcctcacttgttcagttcgtactcaacaagattgaaaggttcagagactttagggtttggctactgttgctaa

SEQ ID NO: 12291 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12292 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttgctactgttgctaa

SEQ ID NO: 12293 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12294 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 12295 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12296 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12297 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattaaagctggacctggtgctcaaatttcacctattgaaattgcttctcagctaccaacaactaaccctgatgcaccagttatgttggaccgaatgttgcgtctcttggcttgttccaatatcctcacttgttcagttcgtactcaacaagatggaaaggttcagagactttatggttgggctactgttgctaa

SEQ ID NO: 12298 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattaaagctggacctggtgctcaaatttcacctattgaaattgcttctcacctcccaacaactaaccctgatgcaccagttatgttggaccgaatgttgcgtctcttggcttgttacaatatcctcacttgttcagttcgtactcaacaagatggaaaggttcagagactttatggtttggctactgtagctaa

SEQ ID NO: 12299 - DNA, 418 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcatggccatcgccagcaatggcggcggcaggccggcgctggagagcattgttgcccagtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12300 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcatggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12301 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcatggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12302 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12303 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12304 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcatggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 12305 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcatgctggacctggtgctcaaatttcacctattgaaattgcttctcagctaccaacaactaaccctgatacaccagttatgttggaccgaatgttgcgtctcttggcttgttacaatatcctcacttgttcagttcgtactcaacaagatggaaagattcagagactttatggtttggctactgttgctaa

SEQ ID NO: 12306 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcatgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12307 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcatgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12308 - DNA, 365 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcatgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12309 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcatctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 12310 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12311 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaaccagatggaaaggttcagagactttatggtttggctactgttg

SEQ ID NO: 12312 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcatctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 12313 - DNA, 389 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcatcggccaacgcgcggggagaggcggtctaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 12314 - DNA, 387 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcatccagcgccggcctgccgccgccattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12315 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12316 - DNA, 440 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcataggatcccccaatccctttttcactgcatccagcgcaggacgcccgccgaggcaggccaaggcgacgaggtggttgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12317 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcatagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12318 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcatagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12319 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcataagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 12320 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12321 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcataagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 12322 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12323 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12324 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12325 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12326 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 12327 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcataaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12328 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12329 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12330 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12331 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12332 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcataaagctggacctggtgctcaaatttcacctattgaaattgcttctcagctaccaacaactaaccctgatgcaccagttatgttggaccgaatgttgcgtctcttggcttgttacaatatcctcacttgttcagttcatactcaacaagatggaaaggttcagagactttatggtttggctactgttgctaa

SEQ ID NO: 12333 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12334 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12335 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12336 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12337 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12338 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcagctggacctggtgctcaaatttcacctattgaaattgcttctcagctcccaacaactaaccctgatgcaccagttatgttggaccgaatgttgcgtcttttggcttgttacaatatcctcacttgttcagttcgtactcaacaagatggaaaggttcagagactttatggtttggctactgttgctaa

SEQ ID NO: 12339 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcagctggacctggtgctcaaatttcacctattgaaattgcttctcagctcccaacaactaaccctgatgcaccagttatgttggaccgaatgttgcgtctcttggcgtgtgacaatatcctcacttgttcagttcgtactcaacaagatggaaaggttcagagactttatggtttggctactgttgctaa

SEQ ID NO: 12340 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcagctggacctggtgctcaaatttcacctattgaaattgcttctcagctcccaacaactaaccctgatgcaccagtcatgttggaccgaatgttgcgtctcttgacttgttacaatatcctcacttgttcagttcgtactcaacaagatggaaaggttcagagactttatggtttggctactgttgctaa

SEQ ID NO: 12341 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaagttcagagactttatggtttggctactgttgctaa

SEQ ID NO: 12342 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12343 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12344 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12345 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttactaa

SEQ ID NO: 12346 - DNA, 394 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcagcgccgccctgccgccgccattgctggcgatgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 12347 - DNA, 475 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcagccgctggaccgtctccagcgcctgcttgccaccgccattgctggcgatggccaccacctgctcgggggtcaagccgtgggccgggcacagcacgggcaacagccgctggagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12348 - DNA, 424 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcagcaggtgttggccatcgccagcaatattggtgccaagcaggcgctggagacggtgcaggcgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12349 - DNA, 390 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcagcaatggcggcggcaggccggcgctggctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12350 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcagacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12351 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcagacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12352 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcagacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12353 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcactggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 12354 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcactggacctggtgctcaaatttcacctattgaaattgcttctcagctcccaacaactaaccctgatgcaccagttatgttggaccgaatgttgcgactcttggcttgttacaatatcctcacttgttcagttcgtactcaacaagatggaaagattcagagactttatggtttggctactgttgctaa

SEQ ID NO: 12355 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12356 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12357 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12358 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12359 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12360 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcactcgacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12361 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcactaagctggacctggtgctcaaatttctcctattgaaattgcttctcagctcccaacaactaaccctgatgcaccagttatgttggaccgaatgtagcgtctcttggcttgttacaatatcctcacttgttcagttcgtactcaacaagatggaaaggttcagagactttatggtttggctactgttgctaa

SEQ ID NO: 12362 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcactaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 12363 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcactaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 12364 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12365 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12366 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12367 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12368 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12369 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcactaaagctggacctggtgcccaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12370 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 12371 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12372 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 12373 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaagttggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12374 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12375 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12376 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 12377 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 12378 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12379 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 12380 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaagctggacctggtgctcaaatttcacctgttcaaattgcttctcagctcccaacaactaaccccgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12381 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12382 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12383 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 12384 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12385 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgtctaa

SEQ ID NO: 12386 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12387 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12388 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 12389 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 12390 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12391 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaagttcagagactttatggtttggctactgttgctaa

SEQ ID NO: 12392 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctttgctaa

SEQ ID NO: 12393 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12394 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttgcaatatcctcacttgttctgttcgtactcaacaagatggaaaggttcagagactttatggtttggctactgttgctaa

SEQ ID NO: 12395 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcagcaagatggaaaggttcagagactttatggtttggctactgttgctaa

SEQ ID NO: 12396 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 12397 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgtccagttcgtactcaacaagatggaaaggttcagagactttatggtttggctactgttgctaa

SEQ ID NO: 12398 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12399 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 12400 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaagctggacctggtgctcaaatttcacctattgaaattgcttctcagctaccaacaactaaccctgatacaccagttatgttggaccgaatgttgcgtctcttggcttgttacaatatcctcacttgttcagttcgtactcaacaagatggaaaggttcagagactttatggtttggctactgttgctaa

SEQ ID NO: 12401 - DNA, 418 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaagccgtgggcctggcacagcaccggcaacagccgctggaccgtctccagcgcctgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12402 - DNA, 418 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaagccgtgggcctggcacagcaccggcaacagccgctggaccgtctccagcgcctgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12403 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaacgctggacctggtgctcaaatttcacctattgaaattgcttctcagctcccaacaactaaccctgatgcaccagttatgttggaccgaatgttgcgtctcttggcttgttacaatatcctcacttgttcagttcttactcaacaagatggaaagattcagagactttatggtttggctactgttgctaa

SEQ ID NO: 12404 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaacctggtgctcaaatttcacctattgaaattgcttctcagctaccaacaactaaccctgatgcaccagttatgttggaccgaatgttgcgtctcttggcttgttgcaatatcctcacttgttcagttcgtactcaacaagatggaaaggttcagagactttatggtttggctactgttgctaa

SEQ ID NO: 12405 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtatggctactgttgctaa

SEQ ID NO: 12406 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaaagctggacctggtgctcaactttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12407 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 12408 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 12409 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12410 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12411 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12412 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgcaa

SEQ ID NO: 12413 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgtgctaa

SEQ ID NO: 12414 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctagtgttgctaa

SEQ ID NO: 12415 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 12416 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaaagctggacctggtgctcaaatttcacctattgaaattgcttctcagctaccaagaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12417 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12418 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12419 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 12420 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12421 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 12422 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaaagctggacctggtgctcaaatttcacctattgaaattgcttctcagctaccaacaactaaccctgatgcaccagttatgttggaccgaatgttgcctctcttggcttgttacaatatcctcacttgttcagttcgtactcaacaagatggaaaggttcagagactttatggtttggctactgttgctaa

SEQ ID NO: 12423 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaaagctggacctggtgctcaaatttcacctattaaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 12424 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaaagctagacctggtgctcaaatttcacctattgcaattgcttctcagctaccaacacctaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12425 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12426 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12427 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 12428 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12429 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12430 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaaaagctggacctggtgctcaaatttcacctattgaaattgcttctcagctaccaacaactaaccctgatgcaccagttatgttggaccgaatgtggcgtctcttggcttgttacaatatcctcacttgttcagttcgtactcaacaagatggaaaggttcagagactttatggtttggctactgttgctaa

SEQ ID NO: 12431 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12432 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcaaaagctggacctggtgctcaaatttcacctattgaaattgcttctcagctaccaacaactaaccctgatacaccagttatgttggaccgaatgttgcgtctcttggcttgttacaatatcctcacttgttcagttcgtactcaacaagatggaaaagttcagagactttatggtttggctactgttgctaa

SEQ ID NO: 12433 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12434 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12435 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 12436 - DNA, 362 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaac

SEQ ID NO: 12437 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12438 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12439 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12440 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatataaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 12441 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 12442 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12443 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12444 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 12445 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12446 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12447 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12448 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 12449 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatagctggacctggtgctcaaatttcacctattgaaattgctcctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12450 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12451 - DNA, 333 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12452 - DNA, 333 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12453 - DNA, 422 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataccacctgctccggggtcaagccgtgggcctggcacagcaccggcaacagccgctggaccgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12454 - DNA, 247 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatacaatatcctcacttgttcagttcgtactcaacaagatggaaaggttcagagactttatggtttggctactgttgctaa

SEQ ID NO: 12455 - DNA, 247 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatacaatatcctcacttgttcagttcgtactcaacaagatggaaagattcagagactttatggtttggctactgttgctaa

SEQ ID NO: 12456 - DNA, 247 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatacaatatcctcacttgttcagttcgtactcaacaagatggaaaagttcagagactttatggtttggctactgttgctaa

SEQ ID NO: 12457 - DNA, 246 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatacaatatcctcacttgttcagttcgtactcaacaagatggaaaagttcagagactttatggtttggctactgtgctaa

SEQ ID NO: 12458 - DNA, 247 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatacaatatcctcacttgttcagttcgtactcaacaagatggaaaagttcagagactttatgatttggctactgttgctaa

SEQ ID NO: 12459 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataagctgggcctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12460 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataagctggaccttgtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12461 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataagctggacctggtgctcgaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12462 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 12463 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12464 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcgcttgttcagttcgtactcaacaagatggaaagattcagagactttatggtttggctactgttgctaa

SEQ ID NO: 12465 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataagctggacctggtgctcaaatttcacctattgaaattgcttctcagctcccaacaactaaccctgatgcaccagttatgttggaccgaatgttgcgtctcttgcttgttacaatatcctcacttgttcagttcgtactcaacaagatggaaagattcagagactttatggtttggctactgttgctaa

SEQ ID NO: 12466 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12467 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12468 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12469 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaagttcagagactttatggtttggctactgttgctaa

SEQ ID NO: 12470 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12471 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12472 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12473 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataagctggacctggtgctcaaatttcacctattgaaattgcttctcagctaccaacaactaaccctgatgcaccagttatgttgaaccgaatgttgcgtctctgggctggttacattatcctcccttgttcagttcgtactcaacaagatgaaaaggttcagagactttagggtttggcaactgttgtta

SEQ ID NO: 12474 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 12475 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataagctggacctagtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12476 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagcttgacctggtgctcaaatttcacctattgaaattgcttctcagctcccaacaactaaccctgatgcaccacttatgttttaccgaatgtttcgtctcttgacttgttacaatatcctcacttattcagttcctactcaacaagatttaaagattcacagactttatggtttagctactgttactaa

SEQ ID NO: 12477 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcgcctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12478 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctgttcaaattgcttctcagctttcaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12479 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12480 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12481 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 12482 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 12483 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12484 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 12485 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 12486 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctattgaaattgcttctcagctcccgacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12487 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctattgaaattgcttctcagctcccaacaactagccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12488 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12489 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12490 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 12491 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12492 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgtgctaa

SEQ ID NO: 12493 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatccgcacttgttcagtgcgtacgcaacaagatggaaaggttcagagactttatggtttggctactgttgctaa

SEQ ID NO: 12494 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggttactgttgctaa

SEQ ID NO: 12495 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtcacttggcttgttacaatatcctctctgtttcagttcgtactcaacaagatagaaagattcagagactttatggtttggcgactgttgctaa

SEQ ID NO: 12496 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 12497 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgttaa

SEQ ID NO: 12498 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctattgaaattgcttctcagctcccaacaactaaccctgatgcaccagttatgttggaccgaatgttgcgtcccttggcttgttacaatatcctcacttgttcagttcgtactcaacaagatggaaagattcagagactttatggtttggctactgttgctaa

SEQ ID NO: 12499 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgcta

SEQ ID NO: 12500 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctattgaaattgcttctcagctaccgacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12501 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12502 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12503 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12504 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggttggctactgttgctaa

SEQ ID NO: 12505 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcgcttgttcagttcgtactcaacaagatggaaaggttcagagactttatggtttggctactgttgtaa

SEQ ID NO: 12506 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatccgcacttgttcagttcttactcaacaagatggaaaggttcagagactttatggtttggctactgttgctaa

SEQ ID NO: 12507 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctctgggcttgttacaatatcctcacttgttcagttcgtactcaacaagatggaaaggttcagagactttatggtttggctactgttgctaa

SEQ ID NO: 12508 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttacgtctcttggcttgttacaatatcctcacttgttcagttcgtactcaacaagatggaaaggttcagagactttatggtttggctactgttgctaa

SEQ ID NO: 12509 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 12510 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatggtgcgtctcttggcttgttacaatatcctcacttgttcagttcgtactcaacaagatggaaaggttcagagactttatggtttggctactgttgctaa

SEQ ID NO: 12511 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggatactgttgctaa

SEQ ID NO: 12512 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctacttgctaa

SEQ ID NO: 12513 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctaatgttgctaa

SEQ ID NO: 12514 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgct

SEQ ID NO: 12515 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagattgaaaagttcagagactttatggtttggctactgttgctaa

SEQ ID NO: 12516 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctattgaaattgcttctcagctaccaacaactaaccctgatgcaccagttatgttggaccgaatgttgcgactcttggcttgttacaatttcctcacttgttcagttcgtactcaacaagatggaaaggttcagagactttatggtttggctactgttgctaa

SEQ ID NO: 12517 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 12518 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 12519 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctggacctggtgctcaaattacacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12520 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagctgaacctggtgctcaaatttcacctattgaaattgcttctcagctcccaacaactaaccctgatgcaccagttatgttggaccgaatgttgcgtctcttggctggttacaatatcctcacttgttcagttcgtactcaacaagatggaaagattcagagactttatggtttggctactgttgctaa

SEQ ID NO: 12521 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaagccggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 12522 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggcgactgttgctaa

SEQ ID NO: 12523 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12524 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaataaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12525 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaagtaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12526 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaggtggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12527 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12528 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 12529 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12530 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 12531 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12532 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12533 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcggagactttatggtttggctactgttgctaa

SEQ ID NO: 12534 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcatactcaacaagatggaaaggttcagagactttatggtttggctactgttgctaa

SEQ ID NO: 12535 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12536 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggttggctactgttgctaa

SEQ ID NO: 12537 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcggttcgtactcaacaagatggaaagattcagagactttatggtttggctactgttgctaa

SEQ ID NO: 12538 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 12539 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctctcttgttcagttcgtactcaacaagatggaaaagttcagagactttatggtttggctactgttgctaa

SEQ ID NO: 12540 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtacccaacaagatggaaagattcagagactttatggtttggctactgttgctaa

SEQ ID NO: 12541 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaagctggacctggtgctcaaatttcacctattgaaattgcttctcagctcccaacaactaaccctgatgcaccagttatgttggaccgaatgtggcgtctcttggcttgttacaatatcctcacttgttcagttcgtactcaacaagatggaaaggttcagagactttatggtttggctactgttgctaa

SEQ ID NO: 12542 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaagctggacctggtgctcaaatttcacctattgaaattgcttctcagctcccaacaactaaccctgatgcaccagttatgttggaccaaatgttgcgtctcttggcttgttacaatatcctcacttgttcagttcgtactcaacaagatggaaagattcagagactttatggtttggctgttgctaa

SEQ ID NO: 12543 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaagctggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 12544 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12545 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttgtcttgttacaatatcctcacttgttcagttcgtactcaacaagatggaaaggttcagagactttatggtttggctactgttgctaa

SEQ ID NO: 12546 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 12547 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgtcgcgtctcttggcttgttacaatatcctcacttgttcagttcgtactcaacaagatggaaaggttcagagactttatggtttggctactgttgctaa

SEQ ID NO: 12548 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 12549 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12550 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtacccaacaagatggaaaggttcagagactttatggtttggctactgttgctaa

SEQ ID NO: 12551 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggtttgttacaatatcctcacttgttcagttcgtactcaacaagatggaaaggttcagagactttatggtttggctactgtgctaa

SEQ ID NO: 12552 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12553 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacagtatcctcacttgttcagttcgtactcaacaagatggaaaggttcagagactttatggtttggctactgttgctaa

SEQ ID NO: 12554 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttccgagactttatggtttggctactgttgctaa

SEQ ID NO: 12555 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcatagactttatggtttggctactgttgctaa

SEQ ID NO: 12556 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggcttgttacaatgtcctcacttgttcagttcgtactcaacaagatggaaaggttcagagactttatggtttggctactgttgctaa

SEQ ID NO: 12557 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaagctggacctggtgctcaaatttcacctattgaaattgcttctcagctaccaacaactaaccctgatgcaccagttatgttggaccgaatgttgcgtctcttggctcgttacaatatcctcacttgttcagttcgtactcaacaagatggaaaggttcagagactttatggtttggctactgttgctaa

SEQ ID NO: 12558 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 12559 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaagctggacctggtgctcaaatttcacctattgaaattgctcctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12560 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaagctaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 12561 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12562 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaagcctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcggagactttatggtttggctactgttgctaa

SEQ ID NO: 12563 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12564 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12565 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12566 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaactaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 12567 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaactaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 12568 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaactaaagctggacctggtgctcaaatttcacctattgaaattgcttctcagctcccaacaactaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12569 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12570 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12571 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaactaaagctggacctggtgctcaaatttcacctattgaaattgcttctcagctcccaacaactaaccccgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12572 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaactaaagctggacctggtgctcaaatttcacctattgaaattgcttctcagctaccaacaactaacccttatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12573 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12574 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12575 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12576 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaactaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 12577 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaactaaagctggacctggtgctcaaatttcacctattgaaattgcttctcagctaccaacaactaaccctgatgcaccagttatgttggaccgaatgttgcgtctcttggcttgttacaatatcctcacttgttcagttcatactcaacaagatggaaagattcagagactttatggtttggctactgttgctaa

SEQ ID NO: 12578 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttccgagactttatggtttggctactgttgctaa

SEQ ID NO: 12579 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12580 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12581 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12582 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgttaa

SEQ ID NO: 12583 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 12584 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 12585 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaacataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 12586 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaacataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12587 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaattaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12588 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12589 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12590 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 12591 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 12592 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcatagactttatggtttggctactgttgctaa

SEQ ID NO: 12593 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12594 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12595 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtctggctactgttgctaa

SEQ ID NO: 12596 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctgctgttgctaa

SEQ ID NO: 12597 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaagctggacctggtgctcaaatttcacctattgaaattgcttctcagctcccaacaactaaccctgatgcaccagttatgttggaccgaatgttgcgtctcctggcttgttacaatatcctcacttgttcagttcgtactcaacaagatggaaagattcagagactttatggtttggctactgttgctaa

SEQ ID NO: 12598 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12599 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12600 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12601 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgtgctaa

SEQ ID NO: 12602 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12603 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttgacttgttacaatatcctcacttgttcagttcgtactcaacaagatggaaaggttcagagactttatggtttggctactgttgctaa

SEQ ID NO: 12604 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctgttgctaa

SEQ ID NO: 12605 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgtgctaa

SEQ ID NO: 12606 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagaaactttatggtttggctactgttgctaa

SEQ ID NO: 12607 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaagctggacctggtgctcaaatttcaccaattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12608 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12609 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12610 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 12611 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaaagctggacctggtgctcaaatttcacctattggaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12612 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaaagctggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 12613 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaaagctggacctggtgctcaaatttcacctattgaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 12614 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12615 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12616 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12617 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaaagctggacctggtgctcaaatttcacctattgaaattgcttctcagctcccaacaactaaccctgatgcaccagttatgttggaccgaatgttgcgtctcttggcttgttacaatgtcctcacttgtacagttcgtactcaacaagatggaaaggttcagagactttatggtttggctactgttgcgaa

SEQ ID NO: 12618 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaaagctggacctggtgctcaaatttcacctattgaaattgcttctcagctcccaacaactaaccctgatgcaccagttatgttggaccgaatgttgcgtctcctggcttgttacaatatcctcacttgttcagttcgtactcaacaagatggaaagattcagagactttatggtttggctactgttgctaa

SEQ ID NO: 12619 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaaagctggacctggtgctcaaatttcacctattgaaattgcttctcagctcccaacaactaaccctgatgcaccagttatgttggaccgaatgttgcgtcacttggcttgttacaatatcctcacttgttcagttcgtactcaacaagatggaaaggttcagagactttatggtttggctactgttgctaa

SEQ ID NO: 12620 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaaagctggacctggtgctcaaatttcacctattgaaattgcttctcagctcccaacaactaaccctgatgcaccagttatgttggacagaatgttgcgtctcttggcttgttacaatatcctcacttgttcagttcgtactcaacaagatggaaaggttcagagactttatggtttggctactgttgctaa

SEQ ID NO: 12621 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12622 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatatcctcacgtgttcagttcgtactcaacaagatggaaagattcagagactttatggtttggctactgttgctaa

SEQ ID NO: 12623 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12624 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12625 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 12626 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 12627 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatagcctcaattgttcagtgcgtactcaacaagatggaaaagttcagagactttatggtttggctactgttgctaa

SEQ ID NO: 12628 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaagttcagagactttatggtttggctactgttgctaa

SEQ ID NO: 12629 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaaagctggacctggtgctcaaatttcacctactgaaattgcttctcagctaccaacaactaaccctgatgcaccagttacgttggaccgaatgttgcgtctcttggcttgttacaatatcctcacttgttcagttcgtactcaacaagatggaaaggttcagagactttatggtttggctactgttgctaa

SEQ ID NO: 12630 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaaagctggacctggtgctcaaatttcaactattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12631 - DNA, 305 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12632 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaaaagctggacctggtgctcaaatttcccctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12633 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaaaagctggacctggtgctcaaatttcacctattgaaattgcttctcagcttccaacaaataaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 12634 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12635 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12636 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12637 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12638 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttctaa

SEQ ID NO: 12639 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12640 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12641 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12642 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12643 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttactaaagctggacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 12644 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 12645 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12646 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttacctggtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaaagttcagagactttatggtttggctactgttgctaa

SEQ ID NO: 12647 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttacaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12648 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12649 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttaaggtggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12650 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttaagctggaccttgtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttagggtttggctactgttgctaa

SEQ ID NO: 12651 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12652 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 12653 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttaagctggacctggtgctcaaatttcacctattgaaattgcttctcggctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 12654 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12655 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12656 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12657 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12658 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12659 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 12660 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 12661 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12662 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12663 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12664 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgct

SEQ ID NO: 12665 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggcttggctactgttgctaa

SEQ ID NO: 12666 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12667 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12668 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12669 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12670 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 12671 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttctaa

SEQ ID NO: 12672 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttaaagctggacctggtgctcaaatttcacctattgaaattgcttctcagctaccaacaactaaccctgatgcaccagttatgttggaccgaatattgcgtctcttggcttgttacaatatcctcacttgttcagttcgtactcaacaagatggaaaggttcagagactttatggtttggctactgttgctaa

SEQ ID NO: 12673 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttaaagctggacctggtgctcaaatttcacctattgaaattgcttctcagctaccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 12674 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttaaagctggacctggtgctcaaatttcacctaatgaaattgcttctcagctaccaacaactaaccctgatgcaccagttatgttggaccgaatgttgcgtctcttggcttgttacaatatcctcacttgttcagttcgtactcaacaagatggaaaagttcagagcctttatggtttggctactgttgctaa

SEQ ID NO: 12675 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctctgtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12676 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctctgtgctcaaatttcacctattgaaattgcttctcagctaccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 12677 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12678 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12679 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12680 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12681 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctctcagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12682 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctctcagaaatctaaagctggacctggtgctcaaatttcacctattgaaattgcttctcagctaccaacaactaaccctgatgcaccagttatgatggaccgaatgttgcgtctcttggcttgttacaatatcctcacttgttcagttcgtactcaacaagatggaaagattcagagactttatggtttggctactgttgctaa

SEQ ID NO: 12683 - DNA, 322 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12684 - DNA, 322 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12685 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12686 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12687 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctctaaagctggacctggtgctcaaatttcacctattgaaattgcttctcagctcccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 12688 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12689 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12690 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12691 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcgtagaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 12692 - DNA, 419 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcggcttgaccccggagcaggtggtggccatcgccagcaatattggtggcaagcaggcgctggagacggtgcagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12693 - DNA, 419 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcggcttgaccccggagcaggtggtggccatcgccagcaatattggtggcaagcaggcgctggagacggtgcagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 12694 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcgctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 12695 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12696 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12697 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12698 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12699 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcgctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12700 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12701 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctccaagctggacctggtgctcaaatttcacctattgaaattgcttctcagctcccaacaactaaccctgatgcaccagttatgttggaccgaatgtggcgtctcttggcttgttacaatatcctcacttgttcagttcgtactcaacaagatggaaagattcagagactttatggtttggctactgttgctaa

SEQ ID NO: 12702 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12703 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12704 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatgggttggctactgttgctaa

SEQ ID NO: 12705 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12706 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12707 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 12708 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12709 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12710 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12711 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12712 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctaagctggacctggtgctcaaatttaacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12713 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 12714 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 12715 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12716 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12717 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12718 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12719 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctaaagctggacctggtgctcaaatttcacctattgaaattgcttctcagctaccaacaactaaccctgatgcaccagttatgttggaccgaatgttgcgtctcttggcttgttacagtatcctcacttgttcagttcgtccgcaacaagaggtaaaggtacagggcctttggggtttggctactgttgctaa

SEQ ID NO: 12720 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatcgctggacctggtgctcaaatttcacgtattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12721 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatcgctggacctggtgctcaaatttcacctattgaaattgcttctcagctcccaacaactaaccctggtgcaccagttatgttggaccgaatgttgcgtctcttggcttgttacaatatcctcacttgttcagttcgtactcaacaagatggaaagattcagagactttatggtttggctactgttgctaa

SEQ ID NO: 12722 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatcgctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12723 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatcctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12724 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgataaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12725 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12726 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12727 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgagtaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12728 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctaatgttgctaa

SEQ ID NO: 12729 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12730 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgagaagctggacctggtgctcaaatttcacctattgaaattgcttctcagctaccaacaactaaccctgatgcaccagttatgttggaccgaatgttgcgtctcttggcttgtgacaatatcctcagttgttcagttcgtactcaacaagatggaaagattcagagactttatggtttggcgactgttgctaa

SEQ ID NO: 12731 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgacctcttagaaaagctgaacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12732 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12733 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12734 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12735 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12736 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12737 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 12738 - DNA, 342 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 12739 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttaaagctggacctggtgctcaaatttcacctgttcaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12740 - DNA, 340 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaactctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12741 - DNA, 340 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaactctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 12742 - DNA, 340 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaactctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12743 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaactcgatctcttagaactaaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 12744 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaactcgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12745 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaactaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 12746 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12747 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaactaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12748 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaactaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12749 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaactaaagctggacctggtgctcaaatttcacctattgaaattgcttcccagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12750 - DNA, 333 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttcctaa

SEQ ID NO: 12751 - DNA, 333 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12752 - DNA, 333 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12753 - DNA, 295 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12754 - DNA, 295 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12755 - DNA, 295 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12756 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacatgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12757 - DNA, 342 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12758 - DNA, 342 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12759 - DNA, 342 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12760 - DNA, 342 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 12761 - DNA, 306 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12762 - DNA, 306 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12763 - DNA, 306 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12764 - DNA, 306 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12765 - DNA, 340 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12766 - DNA, 340 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12767 - DNA, 340 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12768 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12769 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12770 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12771 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctctcgaacttgatctcttagaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtacacaacaagatggaaaggttcagagactttatggtttggctactgttgctaa

SEQ ID NO: 12772 - DNA, 364 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctctcgaacttgatctcttagaaatttgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12773 - DNA, 286 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12774 - DNA, 336 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctaaagctggacctggtgctcaaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12775 - DNA, 336 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12776 - DNA, 336 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12777 - DNA, 336 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12778 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagcccttgaacttgatctcttagaaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12779 - DNA, 306 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12780 - DNA, 331 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12781 - DNA, 331 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12782 - DNA, 331 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12783 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttataatcagctcttgaacttgatctcttagaaatctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 12784 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttagaatcagctcttgaacttgatctcttagaaatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12785 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttagaatcagctcttgaacttgatctctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12786 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaagatcagctcttgaacttgatctcttagaaattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12787 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaagatcagctcttgaacttgatctcttagaaatctaaatctggacttggttatcaaatttcacctattgaaattgcttctcagctcccaacaactaaccctgatgcaccagttatgttggaccgaatgttgcgtctcttggcttgttacaatatcctcacttgttcagttcgtcctcaacaagatggaaagattcagagcctttatggtttagctactgttgctaa

SEQ ID NO: 12788 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaattcagctcttgaacttgatctcttagaaataaagctggacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 12789 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaatcagctcttgaacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12790 - DNA, 426 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaatcagctcttgaacttgatctcttagaaatcagggggtggccatcgccagcaatattggtggcaagcaggcgctggagacggtgcaggggctgttgctaaagctgtacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 12791 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaatcagctcttgaacttgatctcttagaaataagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12792 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaatcagctcttgaacttgatctaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12793 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaagtcagctcttgaacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12794 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaattagctcttgaacttgatctcttagaaatcgtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12795 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaattagctcttgaacttgatctcttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12796 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaattagctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12797 - DNA, 350 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatgagctcttgaacttgatctcttagaaattctggtgctcaaatttcacctattgaaattgcttctcagcttccaacaactaaccctgatgcaccagtcatgttggaccgaatgttgcgtctcttggcttgttataatatcctcacttgttctgttcgtactcaacaagatggaaaggttcagagactttatggtttggctactgttgctaa

SEQ ID NO: 12798 - DNA, 357 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcggctcttgaacttgatctcttagataaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 12799 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcggctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggcttggctactgttctaa

SEQ ID NO: 12800 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcggctcttgaacttgatctcttagaaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12801 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatccgctcttaaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12802 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcatctcttgaacttgatctcttagaaattaaagctggacctggtgctcaaatttcacctattgaaattgcttctcagctaccaacaactaaccctgatgcaccagttatgttggaccgaatgttcgtctcttggcttgttacaatatcctcacttgttcagttcgtactcaacaagatggaaaggttcagagactttatggtttggctactgttgctaa

SEQ ID NO: 12803 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcatctcttgaacttgatctcttagaaatataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12804 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcatctcttgaacttgatctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12805 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcaggtcttgaacttgatctcttagaaatcaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12806 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctctttaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12807 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctctttaacttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12808 - DNA, 352 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctctttaacttgatctcttagaaatcacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12809 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctctttaacttgatctcttagaaatcaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12810 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctctttaacttgatctcttagaaaagctggacctggtgctcaaatttcacctattgaaattgcttctcagctaccaacaactaaccctgatgcaccagttatgttggaccgaatgttgcgtctcttggctagttacaatatcctcacttgttcagttcgtactcaacaagatggaaaggttcagagactgtatggtttggctgctggtgctaa

SEQ ID NO: 12811 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgtctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12812 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgtctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12813 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgtctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12814 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgtctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12815 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgtacttgatctcttagaaataaagctgggcctggtgctcaaatttcacctattgaaattgcttctcagctcccaacaactaaccctgatgcaccagttatgttggaccgaatgttgcgtctcttggcatgttacaatatcctcacttgttcagttcgtactcaacaagatggaaaggttcagagactttatggtttggctactgttgctaa

SEQ ID NO: 12816 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttggacttgatctcttagaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12817 - DNA, 435 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttggacttgatctcttagaaattcccgcggctgttgccggtgctgtgccaggcccacggcttgaccccggagcaggtggtggccatcgccagccacgatggcggcaagcaggcgctggaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 12818 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttggacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12819 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttggacttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12820 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttggacttgatctcttagaaatcattaaagctggacctggtgctcaaatttcacctattgaaattgcttctcagctaccaacaactaaccctgatgcaccagttatgttggaccgaatgttgcgtctcttggcttgttacaatatcctcaattgttcagttcgtactcaacaagatggaaagattcagagactttatggtttggctactgttg

SEQ ID NO: 12821 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttggacttgatctcttagaaacataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggcactgttgctaa

SEQ ID NO: 12822 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttggacttgatctcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12823 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttggacttgatctcttaaagctggacctggtgctcaaatttcacctattgaaattgcttctcagctaccagcaactaaccctgatgcaccagttattttggaccgaatgttgcgtctcttggcttgttacaatatcctcacttgttcagttcgtactcaacaagatggaaaagttcagagactttatggtttggctactgttgctaa

SEQ ID NO: 12824 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgcacttgatctcttagaaacataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12825 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgatcttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12826 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgagcttgatctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12827 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgagcttgatctcttagaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12828 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12829 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12830 - DNA, 337 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgactggacctggttctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12831 - DNA, 337 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgactggacctggtgctcaaatttcacctattgaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 12832 - DNA, 337 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12833 - DNA, 337 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgactggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 12834 - DNA, 337 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12835 - DNA, 336 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgactggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggttggctactgttgctaa

SEQ ID NO: 12836 - DNA, 337 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgactggacctggtgctcaaatttcacctattgaaattgcttctcagctcccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 12837 - DNA, 337 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12838 - DNA, 337 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgactggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12839 - DNA, 337 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgactggacctggtgctcaaatttcacctattgaaattgcttctcagctaccaacaactaaccctgatgcaccagttatgttggaccgaatgttgcgtctcttggcttgttacaatatcctcactttttcagttcgtacccaacaagatggaaagattcagagactttatggtttggctactgttgctaa

SEQ ID NO: 12840 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaatttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12841 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaatttgatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12842 - DNA, 361 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaatttgatctcttagaaatctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12843 - DNA, 320 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaatttcacctgttcaaattgcttctcagcttccaacaactaaccctgatgcaccagttatgttggaccgaatgttgcgtctcttggcttgttacaatatcctcacttgtccagttcgtactcaacaagatggaaagattcagagactttatggtttggctactgttgctaa

SEQ ID NO: 12844 - DNA, 320 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaatttcacctgttcaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12845 - DNA, 320 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 12846 - DNA, 320 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaatttcacctgttcaaattgcttctcagcttccaacaactaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 12847 - DNA, 320 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaatttcacctgttcaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 12848 - DNA, 320 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 12849 - DNA, 320 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaatttcacctgttcaaattgcttctcagcttccaacaactaaccctgatgcaccagtcatgttggaccgaatgttgcgtctcttggcttgttacaatatcctcacttgttctgttcgtactcaacaagatggaaaagttcagagactttatggtttggctactgttgctaa

SEQ ID NO: 12850 - DNA, 320 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12851 - DNA, 320 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaatttcacctgttcaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12852 - DNA, 320 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12853 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12854 - DNA, 343 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12855 - DNA, 358 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaagttgatctcttagaaataagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12856 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaagctggacctggtgctcaaatttcacctattgaaattgcttctcagctcccaacaactaaccctgatgcatcagttatgttggaccgaatgttgcgtctcttggcttgttacaatatcctcacttgttcagttcgtactcaacaagatggaaaggttcagagactttatggtttggctactgttgctaa

SEQ ID NO: 12857 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12858 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12859 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12860 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaagctggacctggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 12861 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12862 - DNA, 338 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgcaa

SEQ ID NO: 12863 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaagctaaagctggacctggtgctcaaatttcacctattgaaattgcttctcagctcccaagaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12864 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12865 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12866 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaagctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12867 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12868 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaagctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12869 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaactttatctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12870 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaactttaaagctggacctggtgctcaaatttcacctattgaaattgcttctcagcttccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12871 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaactttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12872 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaactttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12873 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaactttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12874 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgttctcttagaaatcaagctggacctggtgctcaaatttcacctgttcaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12875 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgttctcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctgctgttgctaa

SEQ ID NO: 12876 - DNA, 332 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 12877 - DNA, 332 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12878 - DNA, 332 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12879 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttggtctcttataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12880 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttggtctcttagaaattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12881 - DNA, 359 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttggtctcttagaaataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12882 - DNA, 363 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatttcttagaaatcactaaagctggacctggtgctcaaatttcacctattgaacttgcttctcagctcccaacaactaaccatgatgcaccagttatgttggaccgaatattgcgtctcttggcttgttacaatatcctcacttgttcagttcgtactcaacaagatggaaaggttcagagactttatggtttggcgactgttgctaa

SEQ ID NO: 12883 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatttcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12884 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatttcttagaaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12885 - DNA, 353 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatttcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12886 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgattaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 12887 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgattaaagctggacctggtgctcaaatttcacctgttcaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 12888 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgattaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12889 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12890 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12891 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 12892 - DNA, 349 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgattaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12893 - DNA, 342 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12894 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaacctaa

SEQ ID NO: 12895 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12896 - DNA, 360 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatcttttagaaatcaaagctggacctggtgctcaaatttcacctattgaaattgcttctcagctcccaacaactaaccctgatgcaccagttatgttggaccgaatgttgcgtctcttggcttgttacaatatcctcacttgttcagttcgaactcaacaagatggaaagattcagagactttatggtttggctactgttgctaa

SEQ ID NO: 12897 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctttgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12898 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctttgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12899 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatcttggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12900 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatcttggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12901 - DNA, 345 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatcttggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12902 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatcttgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12903 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatcttctggacctggtactcaaatttcacctattgaaattgcttctcagctcccaacaactaaccctgatgcaccagttatgttggaccgaatgttgcgtctcttggcttgttacaatatcctcacttattcagttcgtactcaacaagatggaaaggttcagagactttatggtttggctactgttgctaa

SEQ ID NO: 12904 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatcttaaagctggacctggtgctcaaatttcacctattgaaattgcttcttagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12905 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12906 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatcttaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12907 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12908 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatcttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12909 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12910 - DNA, 344 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12911 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctttggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12912 - DNA, 348 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctttggacctggtgctcaaatttcacctattgaaattgcttcccagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12913 - DNA, 354 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctttaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12914 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 12915 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttggtgctcaaatttcacctattgaaattgcttctcagctcccaacaactaaccctgatgcaccagttatgttggaccgagtgttgcgtctcttggcttgttacaatatcctcacttgttcagttcgtactcaacaagatggaaaggttcagagactttatggtttggctactgttgctaa

SEQ ID NO: 12916 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12917 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12918 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttggtgctcaaatttcacctattgaaattgcttctcagctaccaacaactaaccctgatgcaccagttatgttttacccaatgttgcgtctctttacttgttacaatatcctcacttgttcatttcctactcaacaacatgtaaaggttcagagactttatggtttagctactgttgctaa

SEQ ID NO: 12919 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12920 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12921 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttggtgctcaaatttcacctattgaaattgcttctcagctaccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 12922 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttggtgctcaaatttcacctattgaaattgcttctcagctaccaacaactaacccagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12923 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttggtgctcaaatttcacccattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12924 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttggaccttgtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12925 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12926 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12927 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactggtgctaa

SEQ ID NO: 12928 - DNA, 347 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12929 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttggaaatcctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12930 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttgctaaagctggacctggtgctcaaatttcacctattgaaattgcttctcagctcccaacaactaaccctgatgcaccagttatgttggaccgaatgttgcgtctcttggcttgttacaatatcctcacttgttctgttcgtactcaacaagatggaaaagttcagagactttatggtttggctactgttgctaa

SEQ ID NO: 12931 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttgctaaagctggacctggtgctcaaatttcacctattgaaattgcttctcagctcccaacaactaaccctgatgcaccagttatgttggaccgaatgttgcgtctcttggcttgttacaatatcctcccttgttcagttcgtactcaacaagatggaaaggttcagagactttatggtttggctactgttgctaa

SEQ ID NO: 12932 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttgctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12933 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttgctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12934 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttgctaaagctggacctggtgcacaaatttcacctattgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12935 - DNA, 346 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttgacctggtgctcaaatttcacctgttcaaattgcttctcagcttccaacaactaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 12936 - DNA, 320 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12937 - DNA, 320 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12938 - DNA, 320 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttgaaattgcttctcagctcccaacaactaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 12939 - DNA, 320 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttgaaattgcttctcagctcccaacaactaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 12940 - DNA, 320 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12941 - DNA, 320 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12942 - DNA, 320 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttgaaattgcttctcagctaccaacaactaaccctgatgcaccagttatgttggaccgaatgttgcgtctcttggcttgttacaatatcctcacttgttcagttcgtactcaacaagatagaaaggttcagagactttatggtttggctactgttgctaa

SEQ ID NO: 12943 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttctaaagctggacctggtgttcaaatttcacctattgaaattgcttctcagctaccaataactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12944 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12945 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttctaaagctggacctggtgctcaaatttcacctattgaaattgcttctcagctcccaacaactaaccctgatgcaccagttatgttggaccgaatgttgcgtctcttggcttgttacaatatcctcacttgttaagttcgtactcaacaagatggaaagattcagagactttatggtttggctactgttgctaa

SEQ ID NO: 12946 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttctaaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12947 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12948 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12949 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttctaaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 12950 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12951 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttataaagctggacctggtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12952 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12953 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttataaagctggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 12954 - DNA, 355 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttataaagctggacctggtactcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12955 - DNA, 356 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttataaaagctggacctggtgctcaaatttcacctgttcaaattgcttctcagcttccaacaactaaccctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 12956 - DNA, 351 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagttggacctggtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 12957 - DNA, 339 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagtgctcaaatttcacctattgaaattgcttctcagctcccaacaactaaccctgatgcaccagttatgttggaccgaatgttgcgtctcttggcttgttacaatatcctcacttgttcagttcgtactcaacaagatggaaagattcagagactttatggtttggcctgttgctaa

SEQ ID NO: 12958 - DNA, 341 bp, Artificial
  MsCOMT deletion introduced by TALEN pair MsCOMT_T02.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagtgctcaaatttcacctattgaaattgcttctcagctaccaacaactaaccctgatgcaccagttatgttggaccgaatgttgcgtctcttggcttgttacaatatcctcacttgttcagttcgtactcaacaagatggaaaagttcagagactttatggtttggctactgttgctaa
